(12) United States Patent
Liao et al.

(10) Patent No.: US 11,345,938 B2
(45) Date of Patent: May 31, 2022

(54) GENETICALLY MODIFIED CELLS THAT PRODUCE C6-C10 FATTY ACID DERIVATIVES

(71) Applicant: CARGILL, INCORPORATED, Wayzata, MN (US)

(72) Inventors: Hans H. Liao, Plymouth, MN (US); Catherine Bradshaw Poor, Plymouth, MN (US); Travis Robert Wolter, Plymouth, MN (US); Michael Tai Man Louie, Plymouth, MN (US); Erin Kathleen Marasco, Plymouth, MN (US); Ana Negrete-Raymond, Plymouth, MN (US)

(73) Assignee: CARGILL, INCORPORATED, Wayzata, MN (US)

( * ) Notice: Subject to any disclaimer, the term of this patent is extended or adjusted under 35 U.S.C. 154(b) by 0 days.

(21) Appl. No.: 16/482,569

(22) PCT Filed: Feb. 1, 2018

(86) PCT No.: PCT/US2018/016394
§ 371 (c)(1),
(2) Date: Jul. 31, 2019

(87) PCT Pub. No.: WO2018/144701
PCT Pub. Date: Aug. 9, 2018

(65) Prior Publication Data
US 2019/0360010 A1    Nov. 28, 2019

Related U.S. Application Data
(60) Provisional application No. 62/453,817, filed on Feb. 2, 2017.

(51) Int. Cl.
| | | |
|---|---|---|
| C12P 7/64 | (2006.01) | |
| C12N 1/20 | (2006.01) | |
| C12N 9/10 | (2006.01) | |
| C12P 7/6436 | (2022.01) | |
| C12P 7/6409 | (2022.01) | |

(52) U.S. Cl.
CPC .............. *C12P 7/6436* (2013.01); *C12N 1/20* (2013.01); *C12N 9/1029* (2013.01); *C12P 7/6409* (2013.01); *C12Y 203/01199* (2015.07)

(58) Field of Classification Search
None
See application file for complete search history.

(56) References Cited

U.S. PATENT DOCUMENTS

| | | |
|---|---|---|
| 2,408,889 A | 8/1946 | Short |
| 2,464,768 A | 3/1949 | Redmon |
| 2,469,701 A | 5/1949 | Redmon |
| 2,798,053 A | 5/1957 | Brown |
| 3,687,885 A | 8/1972 | Abriss |
| 3,872,037 A | 3/1975 | MacLeod |
| 3,875,101 A | 4/1975 | MacLeod |
| 3,891,591 A | 6/1975 | Chang |
| 3,904,685 A | 9/1975 | Shahidi |
| 3,915,921 A | 10/1975 | Schlatzer, Jr. |
| 4,029,577 A | 6/1977 | Godlewski |
| 4,266,641 A | 5/1981 | Sunohara |
| 4,268,641 A | 5/1981 | Koenig |
| 4,301,266 A | 11/1981 | Muenster |
| 4,431,547 A | 2/1984 | Dubin |
| 4,666,983 A | 5/1987 | Tsubakimoto |
| 4,685,915 A | 8/1987 | Hasse |
| 4,708,997 A | 11/1987 | Stanley, Jr. |
| 4,734,478 A | 3/1988 | Tsubakimoto |
| 4,857,610 A | 8/1989 | Chmelir |
| 4,952,505 A | 8/1990 | Cho |
| 4,985,518 A | 1/1991 | Alexander |
| 5,009,653 A | 4/1991 | Osborn, III |
| 5,093,472 A | 3/1992 | Bresciani |
| 5,135,677 A | 8/1992 | Yamaguchi |
| 5,145,906 A | 9/1992 | Chambers |
| 5,180,798 A | 1/1993 | Nakamura |
| 5,252,474 A | 10/1993 | Gewain |
| 5,274,073 A | 12/1993 | Gruber |
| 5,331,059 A | 7/1994 | Engelhardt |
| 5,342,899 A | 8/1994 | Graham |

(Continued)

FOREIGN PATENT DOCUMENTS

| | | |
|---|---|---|
| CA | 2520795 | 10/2004 |
| CA | 2591599 A | 7/2006 |

(Continued)

OTHER PUBLICATIONS

UniProt Acinetobacter sp. SFD, Beta-ketoacyl-ACP synthase III, ID:A0A178GG61_9GAMM, deposited Sep. 7, 2016. Retrieved from < https://www.uniprot.org/uniprot/A0A178GG61 > on Apr. 2, 2021.*

(Continued)

*Primary Examiner* — Suzanne M Noakes

(57) ABSTRACT

Genes encoding mutant 3-ketoacyl-CoA synthases are introduced into host cells. Certain of the mutants enhance the production of shorter-chain fatty acids and derivatives by the cell than do the wild-type (unmutated) enzymes. In other cases, the chain length is not significantly affected, but productivity is enhanced. In specific cases, both a shift toward lower chain length and higher productivity is seen. Cells producing the mutant 3-ketoacyl-CoA synthases are especially suitable for producing C6-C10 fatty acids and derivatives.

20 Claims, No Drawings

Specification includes a Sequence Listing.

(56) References Cited

U.S. PATENT DOCUMENTS

| | | |
|---|---|---|
| 5,350,799 A | 9/1994 | Woodrum |
| 5,426,199 A | 6/1995 | Lundquist |
| 5,470,928 A | 11/1995 | Harwood |
| 5,487,989 A | 1/1996 | Fowler |
| 5,510,307 A | 4/1996 | Narayanan |
| 5,510,526 A | 4/1996 | Baniel |
| 5,558,656 A | 9/1996 | Bergman |
| 5,616,496 A | 4/1997 | Frost |
| 5,723,639 A | 3/1998 | Datta |
| 5,817,870 A | 10/1998 | Haas |
| 5,827,255 A | 10/1998 | Crainic |
| 5,876,983 A | 3/1999 | Sugimoto |
| 6,004,773 A | 12/1999 | Araki |
| 6,013,494 A | 1/2000 | Nakamura |
| 6,087,140 A | 7/2000 | Cameron |
| 6,117,658 A | 9/2000 | Dennis |
| 6,143,538 A | 11/2000 | Somerville |
| 6,284,495 B1 | 9/2001 | Sato |
| 6,297,319 B1 | 10/2001 | Nagasuna |
| 6,306,636 B1 | 10/2001 | Haselkorn |
| 6,355,412 B1 | 3/2002 | Stewart |
| 6,472,188 B1 | 10/2002 | Lee |
| 6,489,508 B1 | 12/2002 | Van Gansbeghe |
| 6,509,156 B1 | 1/2003 | Stewart |
| 6,534,679 B2 | 3/2003 | Eyal |
| 6,586,229 B1 | 7/2003 | Ben-Bassat |
| 6,593,116 B1 | 7/2003 | Huisman |
| 6,623,944 B2 | 9/2003 | Rieping |
| 6,709,919 B2 | 3/2004 | Tu |
| 6,723,799 B2 | 4/2004 | Sun |
| 6,852,517 B1 | 2/2005 | Suthers |
| 6,960,455 B2 | 11/2005 | Livshits |
| 7,090,998 B2 | 8/2006 | Ishikawa |
| 7,118,896 B2 | 10/2006 | Kalscheuer |
| 7,141,154 B2 | 11/2006 | Lin |
| 7,153,663 B2 | 12/2006 | Payne |
| 7,166,743 B2 | 1/2007 | Zhong |
| 7,186,541 B2 | 3/2007 | Gokarn |
| 7,186,856 B2 | 3/2007 | Meng |
| 7,223,567 B2 | 5/2007 | Ka-Yiu |
| 7,279,598 B2 | 10/2007 | Meng |
| 7,285,406 B2 | 10/2007 | Payne |
| 7,309,597 B2 | 12/2007 | Liao |
| 7,326,557 B2 | 2/2008 | San |
| 7,358,071 B2 | 4/2008 | Payne |
| 7,393,676 B2 | 7/2008 | Gokarn |
| 7,524,660 B2 | 4/2009 | Caimi |
| 7,538,247 B2 | 5/2009 | Craciun |
| 7,638,316 B2 | 12/2009 | Gokarn |
| 7,678,869 B2 | 3/2010 | Matyjaszewski |
| 7,687,661 B2 | 3/2010 | Lilga |
| 7,803,620 B2 | 9/2010 | Weaver |
| 7,826,975 B2 | 11/2010 | Maranas |
| 7,833,761 B2 | 11/2010 | Terashita |
| 7,846,688 B2 | 12/2010 | Gill |
| 7,943,362 B2 | 5/2011 | Frost |
| 7,987,056 B2 | 7/2011 | Gill |
| 8,048,624 B1 | 11/2011 | Lynch |
| 8,076,111 B2 | 12/2011 | Fukui |
| 8,097,439 B2 | 1/2012 | Alibhai |
| 8,110,093 B2 | 2/2012 | Friedman |
| 8,110,670 B2 | 2/2012 | Hu |
| 8,183,028 B2 | 5/2012 | Alibhai |
| 8,268,599 B2 | 9/2012 | Schirmer |
| 8,283,143 B2 | 10/2012 | Hu |
| 8,313,934 B2 | 11/2012 | Bhatia |
| 8,323,924 B2 | 12/2012 | Schirmer |
| 8,372,610 B2 | 2/2013 | Lee |
| 8,377,666 B2 | 2/2013 | Haselbeck |
| 8,467,975 B2 | 6/2013 | Ryan |
| 8,530,221 B2 | 9/2013 | Hu |
| 8,535,916 B2 | 9/2013 | Del Cardayre |
| 8,597,922 B2 | 12/2013 | Alibhai |
| 8,652,816 B2 | 2/2014 | Lynch |
| 8,658,404 B2 | 2/2014 | Schirmer |
| 8,753,840 B2 | 6/2014 | Vermaas |
| 8,809,027 B1 | 8/2014 | Lynch |
| 8,835,137 B2 | 9/2014 | Roberts |
| 8,859,259 B2 | 10/2014 | Rude |
| 8,883,464 B2 | 11/2014 | Lynch |
| 9,388,419 B2 | 7/2016 | Lynch |
| 9,428,778 B2 | 8/2016 | Lynch |
| 9,447,438 B2 | 9/2016 | Liao |
| 9,587,231 B2 | 3/2017 | Hom |
| 10,337,038 B2 | 7/2019 | Lynch |
| 2002/0081684 A1 | 6/2002 | Grobler |
| 2002/0164729 A1 | 11/2002 | Skraly |
| 2003/0004375 A1 | 1/2003 | Mizrahi |
| 2003/0087381 A1 | 5/2003 | Gokarn |
| 2003/0101486 A1 | 5/2003 | Facciotti |
| 2003/0158441 A1 | 8/2003 | Zhong |
| 2003/0159175 A1 | 8/2003 | Ghulam Kadir |
| 2003/0191146 A1 | 10/2003 | Kabbash |
| 2003/0211131 A1 | 11/2003 | Martin |
| 2003/0233675 A1 | 12/2003 | Cao |
| 2003/0235892 A1 | 12/2003 | Katz |
| 2004/0009466 A1 | 1/2004 | Maranas |
| 2004/0076982 A1 | 4/2004 | Gokarn |
| 2004/0077090 A1 | 4/2004 | Short |
| 2004/0152159 A1 | 8/2004 | Causey |
| 2004/0152174 A1 | 8/2004 | Cervin |
| 2004/0209337 A1 | 10/2004 | Frost |
| 2004/0210087 A1 | 10/2004 | Meng |
| 2004/0214294 A1 | 10/2004 | Rieping |
| 2005/0003481 A1 | 1/2005 | Gabriel |
| 2005/0054060 A1 | 3/2005 | Chateau |
| 2005/0196758 A1 | 9/2005 | Rock |
| 2005/0221457 A1 | 10/2005 | Tsobanakis |
| 2005/0221466 A1 | 10/2005 | Liao |
| 2005/0222458 A1 | 10/2005 | Craciun |
| 2005/0233031 A1 | 10/2005 | Hughes |
| 2005/0239179 A1 | 10/2005 | Skraly |
| 2005/0272135 A1 | 12/2005 | Datta |
| 2005/0283029 A1 | 12/2005 | Meng |
| 2006/0014977 A1 | 1/2006 | Miller |
| 2006/0068468 A1 | 3/2006 | Knopf |
| 2006/0084098 A1 | 4/2006 | Gill |
| 2006/0166342 A1 | 7/2006 | Taoka |
| 2007/0010708 A1 | 1/2007 | Ness |
| 2007/0027342 A1 | 2/2007 | Meng |
| 2007/0031918 A1 | 2/2007 | Dunson |
| 2007/0087403 A1 | 4/2007 | Bestel-Corre |
| 2007/0092957 A1 | 4/2007 | Donaldson |
| 2007/0107080 A1 | 5/2007 | Liao |
| 2007/0141574 A1 | 6/2007 | Keasling |
| 2007/0148749 A1 | 6/2007 | Yasuda |
| 2007/0184524 A1 | 8/2007 | Gokarn |
| 2007/0219390 A1 | 9/2007 | Zacher |
| 2007/0245431 A1 | 10/2007 | Metz |
| 2007/0264688 A1 | 11/2007 | Venter |
| 2007/0269862 A1 | 11/2007 | Glass |
| 2007/0270494 A1 | 11/2007 | Metz |
| 2007/0281343 A9 | 12/2007 | Arslanian |
| 2008/0076167 A1 | 3/2008 | Gokarn |
| 2008/0124785 A1 | 5/2008 | Liao |
| 2008/0182308 A1 | 7/2008 | Donaldson |
| 2008/0193989 A1 | 8/2008 | Verser |
| 2008/0199926 A1 | 8/2008 | Burgard |
| 2008/0274523 A1 | 11/2008 | Renninger |
| 2009/0017514 A1 | 1/2009 | Datta |
| 2009/0023006 A1 | 1/2009 | Bub |
| 2009/0031453 A1 | 1/2009 | Jessen |
| 2009/0053783 A1 | 2/2009 | Gokarn |
| 2009/0076297 A1 | 3/2009 | Bogan, Jr. |
| 2009/0082286 A1 | 3/2009 | Huang |
| 2009/0111151 A1 | 4/2009 | Julien |
| 2009/0148914 A1 | 6/2009 | Causey |
| 2009/0203097 A1 | 8/2009 | Flint |
| 2009/0234146 A1 | 9/2009 | Cooney |
| 2009/0246141 A1 | 10/2009 | Hirai |
| 2009/0291480 A1 | 11/2009 | Jessen |
| 2009/0298144 A1 | 12/2009 | Tsobanakis |
| 2009/0305369 A1 | 12/2009 | Donaldson |
| 2009/0325248 A1 | 12/2009 | Marx |

(56) References Cited

U.S. PATENT DOCUMENTS

| | | |
|---|---|---|
| 2010/0021978 A1 | 1/2010 | Burk |
| 2010/0028962 A1 | 2/2010 | Hu |
| 2010/0037329 A1 | 2/2010 | Frommer |
| 2010/0064381 A1 | 3/2010 | Zou |
| 2010/0068773 A1 | 3/2010 | Marx |
| 2010/0099910 A1 | 4/2010 | Meng |
| 2010/0113822 A1 | 5/2010 | Craciun |
| 2010/0151536 A1 | 6/2010 | Baynes |
| 2010/0170148 A1 | 7/2010 | Steen |
| 2010/0186117 A1 | 7/2010 | Fabijanski |
| 2010/0210017 A1 | 8/2010 | Gill |
| 2010/0257777 A1 | 10/2010 | Sanchez-Riera |
| 2010/0257778 A1 | 10/2010 | Gaertner |
| 2010/0261239 A1 | 10/2010 | Soucaille |
| 2010/0274033 A1 | 10/2010 | Sanchez-Riera |
| 2010/0285549 A1 | 11/2010 | Muramatsu |
| 2010/0291644 A1 | 11/2010 | Marx |
| 2011/0020883 A1 | 1/2011 | Roessler |
| 2011/0038364 A1 | 2/2011 | Monsieux |
| 2011/0072714 A1 | 3/2011 | Gaertner |
| 2011/0089016 A1 | 4/2011 | Winkelaar |
| 2011/0124063 A1 | 5/2011 | Lynch |
| 2011/0125118 A1 | 5/2011 | Lynch |
| 2011/0144377 A1 | 6/2011 | Eliot |
| 2011/0159558 A1 | 6/2011 | Grady |
| 2011/0162259 A1 | 7/2011 | Gaertner |
| 2011/0171702 A1 | 7/2011 | Reinecke |
| 2011/0183382 A1 | 7/2011 | Schmalisch |
| 2011/0183388 A1 | 7/2011 | Sabirova |
| 2011/0183391 A1 | 7/2011 | Frost |
| 2011/0190513 A1 | 8/2011 | Lynch |
| 2011/0214979 A1 | 9/2011 | Chen |
| 2011/0244575 A1 | 10/2011 | Lipscomb |
| 2011/0275851 A1 | 11/2011 | Orjuela |
| 2011/0281314 A1 | 11/2011 | Lynch |
| 2012/0041232 A1 | 2/2012 | Lynch |
| 2012/0058530 A1 | 3/2012 | Zhang |
| 2012/0116108 A1 | 5/2012 | Basu |
| 2012/0129231 A1 | 5/2012 | Wang |
| 2012/0135481 A1 | 5/2012 | Jessen |
| 2012/0240289 A1 | 9/2012 | Feussner |
| 2012/0244586 A1 | 9/2012 | Gokarn |
| 2012/0244588 A1 | 9/2012 | Park |
| 2012/0264902 A1 | 10/2012 | Lipscomb |
| 2012/0329110 A1 | 12/2012 | Kim |
| 2013/0071893 A1 | 3/2013 | Lynch |
| 2013/0078684 A1 | 3/2013 | Holtzapple |
| 2013/0078686 A1 | 3/2013 | Holtzapple |
| 2013/0122541 A1 | 5/2013 | Lynch |
| 2013/0122562 A1 | 5/2013 | Aldor |
| 2013/0189787 A1 | 7/2013 | Lynch |
| 2013/0316413 A1 | 11/2013 | Gonzalez |
| 2013/0345470 A1 | 12/2013 | Tengler |
| 2014/0051136 A1 | 2/2014 | Liao |
| 2014/0121118 A1 | 5/2014 | Warner |
| 2014/0135526 A1 | 5/2014 | Lynch |
| 2014/0215904 A1 | 8/2014 | Pandey |
| 2014/0242648 A1 | 8/2014 | Ochiai |
| 2014/0309451 A1 | 10/2014 | Tengler |
| 2014/0330032 A1 | 11/2014 | Lynch |
| 2015/0044746 A1 | 2/2015 | Meerman |
| 2015/0056669 A1 | 2/2015 | Liao |
| 2015/0064754 A1 | 3/2015 | Liao |
| 2015/0119601 A1 | 4/2015 | Liao |
| 2015/0299679 A1 | 10/2015 | Shumaker |
| 2016/0060663 A1 | 3/2016 | Grammann |
| 2016/0090576 A1 | 3/2016 | Garg |
| 2016/0257975 A1 | 9/2016 | Lynch |
| 2016/0340700 A1 | 11/2016 | Liao |

FOREIGN PATENT DOCUMENTS

| | | |
|---|---|---|
| CA | 2654133 A1 | 12/2007 |
| CN | 1301304 A | 6/2001 |
| CN | 101679924 B | 6/2013 |
| CN | 101573451 B | 4/2014 |
| CN | 103975070 A | 8/2014 |
| CN | 102869768 A | 11/2016 |
| DE | 102008002309 A1 | 12/2009 |
| EP | 1124789 B1 | 9/2004 |
| EP | 1036190 B1 | 5/2005 |
| EP | 1305439 B1 | 6/2006 |
| EP | 1124979 B1 | 8/2006 |
| EP | 1731604 A1 | 12/2006 |
| EP | 1105514 B1 | 2/2008 |
| EP | 1778840 B1 | 6/2008 |
| EP | 1654212 B1 | 7/2009 |
| EP | 1706457 B1 | 2/2012 |
| EP | 2594633 A1 | 5/2013 |
| EP | 2133420 B1 | 4/2014 |
| EP | 1975236 B1 | 5/2015 |
| EP | 3103867 B1 | 5/2018 |
| EP | 2993228 B1 | 10/2019 |
| GB | 2473755 B | 9/2011 |
| JP | 2010259388 A | 11/2010 |
| JP | 2011512848 A | 4/2011 |
| KR | 2007096348 | 10/2007 |
| KR | 20120108538 A | 10/2012 |
| WO | 9821339 A1 | 5/1998 |
| WO | 9855442 A1 | 12/1998 |
| WO | 9914343 A1 | 3/1999 |
| WO | 0039287 W2 | 7/2000 |
| WO | 0056693 A1 | 9/2000 |
| WO | 0061740 A1 | 10/2000 |
| WO | 2000071738 A1 | 11/2000 |
| WO | 0116346 A1 | 3/2001 |
| WO | 0138284 A1 | 5/2001 |
| WO | 0208428 A2 | 1/2002 |
| WO | 0234784 A2 | 5/2002 |
| WO | 0242418 A2 | 5/2002 |
| WO | 2002042471 A2 | 5/2002 |
| WO | 02090312 W | 11/2002 |
| WO | 03040690 A2 | 5/2003 |
| WO | 2003049525 A2 | 6/2003 |
| WO | 03062173 A2 | 7/2003 |
| WO | 03082795 A2 | 10/2003 |
| WO | 2003102152 A2 | 12/2003 |
| WO | 2003102201 A2 | 12/2003 |
| WO | 2004018621 A2 | 3/2004 |
| WO | 2004033646 A2 | 4/2004 |
| WO | 2005003074 A1 | 1/2005 |
| WO | 2005047498 A1 | 5/2005 |
| WO | 2005105770 A2 | 11/2005 |
| WO | 2005118719 A2 | 12/2005 |
| WO | 2006034156 A2 | 3/2006 |
| WO | 2006052871 A2 | 5/2006 |
| WO | 2006052914 A2 | 5/2006 |
| WO | 2006121755 A2 | 11/2006 |
| WO | 2007012078 A1 | 1/2007 |
| WO | 2007030830 A2 | 3/2007 |
| WO | 2007042494 A2 | 4/2007 |
| WO | 2007047680 A2 | 4/2007 |
| WO | 2007093848 A2 | 8/2007 |
| WO | 2007106903 A2 | 9/2007 |
| WO | 2007130745 A1 | 11/2007 |
| WO | 2007136762 A2 | 11/2007 |
| WO | 2008021765 A2 | 2/2008 |
| WO | 2008023039 A1 | 2/2008 |
| WO | 2008027742 A1 | 3/2008 |
| WO | 2008028002 A1 | 3/2008 |
| WO | 2008072920 A1 | 6/2008 |
| WO | 2008089102 A2 | 7/2008 |
| WO | 2008091627 A2 | 7/2008 |
| WO | 2008145737 A1 | 12/2008 |
| WO | 2008149951 A1 | 12/2008 |
| WO | 2009006430 A1 | 1/2009 |
| WO | 2009031737 A1 | 3/2009 |
| WO | 2009036095 A1 | 3/2009 |
| WO | 2009062190 A2 | 5/2009 |
| WO | 2009089457 A1 | 7/2009 |
| WO | 2009094485 A1 | 7/2009 |
| WO | 2009111513 A1 | 9/2009 |
| WO | 2009111672 A1 | 9/2009 |
| WO | 2009121066 A1 | 10/2009 |

(56) References Cited

FOREIGN PATENT DOCUMENTS

| | | |
|---|---|---|
| WO | 2009143401 A2 | 11/2009 |
| WO | 2009151342 A1 | 12/2009 |
| WO | 2009156469 A1 | 12/2009 |
| WO | 2010006076 A2 | 1/2010 |
| WO | 2010011874 A2 | 1/2010 |
| WO | 2010017230 A2 | 2/2010 |
| WO | 2010031083 A2 | 3/2010 |
| WO | 2010105095 A1 | 9/2010 |
| WO | 2011002892 A2 | 1/2011 |
| WO | 2011008565 A1 | 1/2011 |
| WO | 2011038364 A1 | 3/2011 |
| WO | 2011063304 A1 | 5/2011 |
| WO | 2011063363 A2 | 5/2011 |
| WO | 2011094457 A1 | 8/2011 |
| WO | 2012017083 A1 | 2/2012 |
| WO | 2012019175 A2 | 2/2012 |
| WO | 2012050931 A2 | 4/2012 |
| WO | 2012054400 A1 | 4/2012 |
| WO | 2012129450 A1 | 9/2012 |
| WO | 2012135760 A1 | 10/2012 |
| WO | 2012177726 A1 | 12/2012 |
| WO | 2013003608 A1 | 1/2013 |
| WO | 2013019647 A1 | 2/2013 |
| WO | 2013039563 A1 | 3/2013 |
| WO | 20130039563 W | 3/2013 |
| WO | 2013048557 A1 | 4/2013 |
| WO | 2013126855 A1 | 8/2013 |
| WO | 2013152051 A2 | 10/2013 |
| WO | 2013152052 A2 | 10/2013 |
| WO | 2013192450 A1 | 12/2013 |
| WO | 2013192451 A1 | 12/2013 |
| WO | 2013192453 A1 | 12/2013 |
| WO | 2014026162 A1 | 2/2014 |
| WO | 2014042693 A1 | 3/2014 |
| WO | 2014145096 A1 | 9/2014 |
| WO | 2014145297 A1 | 9/2014 |
| WO | 2014145332 A1 | 9/2014 |
| WO | 2014145334 A1 | 9/2014 |
| WO | 2014145343 A1 | 9/2014 |
| WO | 2014145344 A2 | 9/2014 |
| WO | 2014146026 A1 | 9/2014 |
| WO | 2014146047 A1 | 9/2014 |
| WO | 2014198831 A1 | 12/2014 |
| WO | 2015010103 A2 | 1/2015 |
| WO | 2015042626 A1 | 4/2015 |

OTHER PUBLICATIONS

UniProt Acinetobacter tjernbergiae DSM 14971, 3-oxoacyl-[acyl-carrier-protein] synthase, ID:V2UVU7_9GAMM, deposited Jan. 22, 2014. Retrieved from < https://www.uniprot.org/uniprot/V2UVU7 > on Apr. 2, 2021.*

Witkowski, et al., "Conversion of a beta-ketoacyl synthase to a malonyl decarboxylase by replacement of the active-site cysteine with glutamine.", Biochemistry. 38(36), Sep. 7, 1999, 11643-50.

Wyckoff, et al., "Characterization and sequence analysis of a stable cryptic plasmid from Enterococcus faecium 226 and development of a stable cloning vector", Appl Environ Microbiol. Apr. 1996; 62(4): 1481-1486.

Xie, Dongming, et al., "Microbial Synthesis of Triacetic Acid Lactone", Biotechnol Bioeng. 93(4), Mar. 5, 2006, 727-36.

Xu, et al., "English Translation: Principles and Experiments of Biotechnology", China Minzu University Press. (English Translation), Jul. 2006, 229-231.

Xu, Xiaowei, "Fatty acid synthase inhibitors: research advances", Journal of international pharmaceutical research. vol. 36(2). (English abstract), 2009, 105-108, 120.

Y. Yuan et al: "Pseudomonas aeruginosa Directly Shunts -Oxidation Degradation Intermediates into De Novo Fatty Acid Biosynthesis", Journal of Bacteriology, vol. 194, No. 19, Oct. 1, 2012, pp. 5185-5196, XP055749981, ISSN: 0021-9193, DOI: 10.1128/JB.00860-12.

Yee, et al., "On the role of helix 0 of the tryptophan synthetase alpha chain of Escherichia coli.", J Biol Chem. 271(25), Jun. 21, 1996, 14754-63.

Yiming Ren, et al., "Molecular Iodine in Ionic Liquid: A Green Catalytic System for Esterification and Transesterification", Synthetic Communications. 40(11), 2010, 1670-1676.

Yoshida, et al., "Identification of PhoB binding sites of the yibD and ytfK promoter regions in Escherichia coli", J Microbiol. 49(2), Apr. 2011, 285-289.

Zha, Wenjuan, et al., "Improving cellular malonyl-CoA level in Escherichia coli via metabolic engineering", Metab Eng. 11(3), May 2009, 192-8.

Zhang, et al., "Inhibiting bacterial fatty acid synthesis", J. Biol. Chem. 281(26), Jun. 30, 2006, 17541-17544.

Zhang, Z et al., "Metabolic engineering of microbial pathways for advanced biofuels production", Current Opinion in Biotechnology, vol. 22, No. 6, ISSN 0958-1669, pp. 775-783.

Zhao, "Binding of two flaviolin substrate molecules, oxidative coupling, and crystal structure of Streptomyces coelicolor A3(2) cytochrome P450 158A2.", J Biol Chem. 280(12), Mar. 25, 2005, 11599-607.

Zhou, et al., "Interdomain communication between the thiolation and thioesterase domains of EntF explored by combinatorial mutagenesis and selection", Chem Biol. 13(8), Aug. 2006, 869-79.

Mehta, et al., "Aminotransferases: demonstration of homology and division into evolutionary subgroups", Eur J Biochem. 214(2), Jun. 1, 1993, 549-61.

Meng, et al., "Nucleotide sequence of the Escherichia coli cad operon: a system for neutralization of low extracellular pH", J. Bacteriol. vol. 174 No. 8, Apr. 1992, 2659-2669.

Meng, Xin, et al., "Increasing fatty acid production in E. coli by simulating the lipid accumulation of oleaginous microorganisms", Journal of Industrial Microbiology and Biotechnology. 38(8), 2011, 919-925.

Milton, et al., "In vitro mutagenesis and overexpression of the Escherichia coli trpA gene and the partial characterization of the resultant tryptophan synthase mutant alpha-subunits", Biol Chem. 261(35), Dec. 15, 1986, 16604-15.

Mohan Raj, et al., "Effect of process parameters on 3-hydroxypropionic acid production from glycerol using a recombinant Escherichia coli", Appl Microbiol Biotechnol. 84(4), Sep. 2009, 649-57.

Moreau, et al., "Diversion of the metabolic flux from pyruvate dehydrogenase to pyruvate oxidase decreases oxidative stress during glucose metabolism in nongrowing Escherichia coli cells incubated under aerobic, phosphate starvation conditions", J Bacteriol. 186(21), Nov. 2004, 7364-8.

Muday, et al., "The tyrosine repressor negatively regulates aroH expression in Escherichia coli", 173(12), Jun. 1991, 3930-2.

Musayev, et al., Crystal Structure of a Substrate Comlex of Mycobacterium tuberculosis b-Ketoacyl-acyl Carrier Protein Synthase III (FabH) with Lauroyl-coenzyme AJ. Mol. Biol. (2005), 346, 1313-1321.

Nackley, et al., "Human Catechol-O-Methyltransferase Haplotypes Modulate Protein Expression by Altering mRNA Secondary Structure", Science. 314(5807)., Dec. 22, 2006, 1930-3.

Nelson, David L., et al., "Principles of Biochemistry 3rd Ed.", Worth Publishers New York, 2000, 527-658.

Nichols, "Cloning and sequencing of Escherichia coli ubiC and purification of chorismate lyase", J Bacteriol. 174(16), Aug. 1992, 5309-16.

Nicholson. Lipid Metabolism. Graphic design. 2002.

Nugent. Development of Improved Chemicals and Plastics from Oilseeds. Final technical report. The Dow Chemical Company. DE-FC36-01ID14213. Jul. 31, 2006.

Ohmiya, et al., "Structure of Cellulases and Their Applications", Biotechnol. Genet. Eng. Rev., vol. 14, 1997, 365-414.

Ohnishi, et al., "A novel methodology employing Corynebacterium glutamicum genome information to generate a new L-lysine-producing mutant", Appl Microbiol Biotechnol. 58(2), Feb. 2002, 217-23.

Okamura, E et al., "Unprecedented acetoacetyl-coenzyme A synthesizing enzyme of the thiolase superfamily involved in the mevalonate

(56) References Cited

OTHER PUBLICATIONS pathway", Proceedings of the National Academy of Sciences, vol. 107, No. 25, ISSN 0027-8424, pp. 11265-11270.
Oliveira, et al., "Cloning and Overexpression in Soluble Form of Functional Shikimate Kinase and 5-Enolpyruvylshikimate 3-Phosphate Synthase Enzymes from *Mycobacterium tuberculosis*", Protein Expr Purif. 22(3)., Aug. 2001, 430-5.
Orjuela, et al., "Presentation: Recovery of succinic acid from fermentative broth through esterification with ethanol", Department of Chemical Engineering and Materials Science. Michigan State University. East Lansing, Michigan 48824, Jun. 29, 2010.
O'Sullivan, et al., "High- and low-copy-number Lactococcus shuttle cloning vectors with features for clone screening", Gene. vol. 137, Issue 2, Dec. 31, 1993, pp. 227-231.
Ozcelik, et al., "Metabolic engineering of aromatic group amino acid pathway in Bacillus subtilis for L-phenylalanine production", Chemical Engineering Science. 59(22-23):, 2004, 5019-5026.
Papanikolaou, Seraphim, et al., "Lipid production by Yarrowia lipolytica growing on industrial glycerol in a single-stage continuous culture", Bioresour Technol. 82(1), Mar. 2002, 43-9.
Parikh, et al., "Directed evolution of RuBisCO hypermorphs through genetic selection in engineered *E. coli*", Protein Eng Des Sel. 19(3), Mar. 2006, 113-9.
Park, et al., "Production of alternatives to fuel oil from organic waste by the alkane-producing", Vibrio furnissii MI, Journal of Applied Microbiology, 2005, vol. 98, No. 2, pp. 324-331.
Partial European Search Report dated Jan. 8, 2016 in Patent Application No. 15182914.0.
Patnaik, et al., "Genome shuffling of Lactobacillus for improved acid tolerance", Nat Biotechnol. 20(7), Jul. 2002, 707-12.
Pohl, et al., "A new perspective on thiamine catalysis", Curr Opin Biotechnol. 15(4), Aug. 2004, 335-42.
Ponce, et al., "toning of the Two Pyruvate Kinase Isoenzyme StructuralGenes from *Escherichia coli*: the Relative Roles of These Enzymes in Pyruvate Biosynthesis", J Bacteriol. 177(19), Oct. 1995, 5719-22.
Popp, J., "Sequence and overexpression of the menD gene from *Escherichia coli*", J Bacteriol. 171(8), Aug. 1989, 4349-54.
Prather, Kristala L, et al., "De novo biosynthetic pathways: rational design of microbial chemical factories", Curr Opin Biotechnol 19(5), Oct. 19, 2008, 468-74.
Price-Carter, et al., "Polyphosphate kinase protects *Salmonella enterica* from weak organic acid stress", Journal of Bacteriology. 187, 2005, 3088-3099.
Ramalinga, et al., "A mild and efficient method for esterification and transesterification catalyzed by iodine", Tetrahedron Letters. 43(5), 2002, 879-882.
Ramey, et al., "Poster—Translation of genomics data into useful metabolic engineering strategies: construction of a 3-hydroxypropionic acid tolerant *E. coli*", 2010.
Ramilo, et al., "Overexpression, purification, and characterization of tyrosine-sensitive 3-deoxy-D-arabino-heptulosonic acid 7-phosphate synthase from *Escherichia coli*", Protein Expr Purif. 9(2), Mar. 1997, 253-61.
Rathnasingh, et al., "Development and evaluation of efficient recombinant *Escherichia coli* strains for the production of 3-hydroxypropionic acid from glycerol", Biotechnol Bioeng. 104(4). doi: 10.1002/bit.22429., Nov. 1, 2009, 729-39.
Rathnasingh, Chelladurai, et al., "Production of 3-hydroxypropionic acid via malonyl-COA pathway using recombinant *Escherichia coli* strains", J Biotechnol. 157(4), Feb. 20, 2012, 633-40.
Ray, et al., "Mutational analysis of the catalytic and feedback sites of the tryptophan-sensitive 3-deoxy-D-arabino-heptulosonate-7-phosphate synthase of *Escherichia coli*", J Bacteriol. 170(12), Dec. 1988, 5500-6.
Renault, et al., "Plasmid vectors for Gram-positive bacteria switching from high to low copy number", Gene. vol. 183, Issues 1-2, 1996, pp. 175-182.
Rodriguez, et al., "Structure-cytoprotective activity relationship of simple molecules containing an alpha,beta-unsaturated carbonyl system", J Med Chem. 40(12), Jun. 6, 1997, 1827-34.
Roe, et al., "Inhibition of *Escherichia coli* growth by acetic acid: a problem with methionine biosynthesis and homocysteine toxicity", Microbiology. 148(Pt 7), Jul. 2002, 2215-2222.
Sadowski, M. I., et al., "The sequence-structure relationship and protein function prediction", Current Opinion in Structural Biology 19, 2009, 357-362.
Saerens, S. M. G., et al., "Parameters Affecting Ethyl Ester Production by *Saccharomyces cerevisiae* during Fermentation", Appl Environ Microbiol. 74(2), Jan. 2008, 454-61.
Saier, et al., "The catabolite repressor/activator (Cra) protein of enteric bacteria", J Bacteriol. 178(12), Jun. 1996, 3411-7.
Salis, Howard M., et al., "Automated Design of Synthetic Ribosome Binding Sites to Precisely Control Protein Expression", Nat Biotechnol 27(10), Oct. 2009, 946-50.
Sambrook and Russell, "Molecular Cloning: A Laboratory Manual," Third Edition 2001 (vols. 1-3), Cold Spring Harbor Laboratory Press, Cold Spring Harbor, N.Y.
Sauna, et al., "Silent polymorphisms speak: how they affect pharmacogenomics and the treatment of cancer", Cancer Research. 67(20), Oct. 15, 2007, 9609-12.
Schmid, Katherine M., et al., "Lipid Metabolism in Plants", Biochemistry of Lipids, Lipoproteins and memebranes. Ch 4, 2002, 93-126.
Schmidt-Dannert, et al., "Molecular breeding of carotenoid biosynthetic pathways", Nat Biotechnol. 18(7), Jul. 2000, 750-3.
Seffernick, Jennifer L., et al., "Melamine Deaminase and Atrazine Chlorohydrolase: 98 Percent Identical but Functionally Different", J Bacteriol. 183(8), Apr. 2001, 2405-10.
Sen, S., et al., "Developments in Directed Evolution for Improving Enzyme Functions", Appl Biochem Biotechnol. 143(3), Dec. 2007, 212-23.
Service, "Sugary Recipe Boosts Grow-Your-Own Plastics", Science. 312(5782), Jun. 30, 2006, 1861.
"Advances in the Research of β-Ketoacyl-ACP Synthase III (FabH) Inhibitors", Liu xiaobo, et 2 al., Progress in Chemistry, 2009, vol. 21, No. 9, pp. 1930-1938, Sep. 30, 2009).
"Agriculture Project Fact Sheet", U.S. Department of Energy, Office of Industrial Technologies. Jul. 2001.
"Energetics Incorporated. 2003. Industrial Bioproducts: Today and Tomorrow. U.S. Department of Energy, Office of Energy Efficiency and Renewable Energy, Office of the Biomass Program, Washington, D.C.".
"GenBank Accession No. AAC74497.1; Apr. 24, 2007. 2 pgs."
"GenBank Accession No. NP 415816.1; available 1997".
"GenBank Accession No. NP 415933.1; available 1997".
"GenBank Accession No. NP 418045.4; available 1997".
"GenBank Accession No. X81461", AF473544, Sep. 7, 1994.
"GenBank Accession No. AAS20429.1", Jan. 19, 2004.
"NCBI Reference Sequence: NP_414657.1", Jan. 16, 1997.
"NCBI Reference Sequence: NP_415792.1", Jan. 16, 1997.
"NCBI Reference Sequence: NP_416366.1", Jan. 16, 1997.
"NCBI Reference Sequence: NP_418812.1", Jan. 16, 1997.
"NCBI Reference Sequence: WP_011957906.1", Jun. 6, 2007.
"NCBI Reference Sequence: WP_012121415.1", Sep. 4, 2007.
"NCBI Reference Sequence: WP_012616528.1", Dec. 29, 2008.
"NCBI Reference Sequence: YP_001636209.1", Dec. 21, 2007.
"NCBI Reference Sequence: ZP_01039179.1", Jan. 16, 2006.
"NCBI Reference Sequence: ZP_01626393.1", Dec. 15, 2006.
"NCBI Reference Sequence: ZP_04957196.1", Sep. 15, 2008.
"NCBI Reference Sequence: ZP_05125944.1", Sep. 15, 2008.
"Nexant, Inc. Chemsystems Perp Program, Acrylic Acid, 08/09-3", Jul. 2010.
Abdel-Hamid, Ahmed M., et al., "Coordinate Expression of the Acetyl Coenzyme A Carboxylase Genes, accB and accC, Is Necessary for Normal Regulation of Biotin Synthesis in *Escherichia coli*", J Bacteriol. 189(2), Jan. 2007, 369-76.
Alber, et al., "Malonyl-coenzyme A reductase in the modified 3-hydroxypropionate cycle for autotrophic carbon fixation in archaeal Metallosphaera and Sulfolobus spp.", spp. J Bacteriol. Dec. 2006;188(24):8551-9.

(56) References Cited

OTHER PUBLICATIONS

Alberts, et al. Molecular Biology of the Cell. 3rd Ed. Garland Publishing, New York 1994; 42-45, 66-74.
Anagnostopoulos, C., et al., "Requirements for Transformation in Bacillus Subtilis", J Bacteriol. 81(5), May 1961, 741-6.
Anton, et al., "Sequencing and Overexpression of the *Escherichia coli* Aroe Gene Encoding Shikimate Dehydrogenase", Biochem J. Jan. 15, 1988;249(2):319-26.
Armstrong, S. M., et al., "Abiotic conversion of dihydrophloroglucinol to resorcinol", Canadian Journal of Microbiology. 39(9), 1993, 899-902.
Arthur, et al., "Contribution of VanY D,D-carboxypeptidase to glycopeptide resistance in Enterococcus faecalis by hydrolysis of peptidoglycan precursors", Antimicrob Agents Chemother. 38(9), Sep. 1994, 1899-1903.
Asano, et al., "A new enzymatic method of acrylamide production", Agricultural and Biological Chemistry. 46(5), 1982, 1183-1189.
Baek, Jong Hwan, et al., "Novel gene members in the Pho regulon of *Escherichia coli*", FEMS Microbiol Lett. 264(1), Nov. 2006, 104-9.
Bailey, et al., "Inverse metabolic engineering: A strategy for directed genetic engineering of useful phenotypes", BBiotechnol Bioeng. 79(5), Sep. 5, 2002, 568-79.
Bailey, et al., "Toward a science of metabolic engineering", Science;252(5013):, Jun. 21, 1991, 1668-75.
Bailey, et al. Biochemical Engineering Fundamentals, 2nd Ed. McGraw Hill, New York, 1986, entire book for purposes indicated and Chapter 9, pp. 533-657.
Barbin, et al., "Induction of specific base-pair substitutions in *E. coli* trpA mutants by chloroethylene oxide, a carcinogenic vinyl chloride metabolite", Mutat Res. Nov.-Dec. 1985;152(2-3):147-56.
Bastian, et al., "Engineered ketol-acid reductoisomerase and alcohol dehydrogenase enable anaerobic 2-methylpropan-l-ol production at theoretical yield in *Escherichia coli*", Metab Eng. May 2011;13(3):345-52.
Beguin, et al., "The biological degradation of cellulose", FEMS Microbiol Rev. Jan. 1994;13(1):25-58.
Beisson, Frederic, et al., "*Arabidopsis* Genes Involved in Acyl Lipid Metabolism. A 2003 Census of the Candidates, a Study of the Distribution of Expressed Sequence Tags in Organs, and a Web-Based Database", Plant Physiol. 132(2), Jun. 2003, 681-97.
Bellion, Edward, et al., "Methylamine Utilization in Yeast and Bacteria: Studies Using in vivo NMR", Micro b. Growth C1 Compd. (Int. Symp.) 7th Editors: Murrell, J. Collin: Kelly, Don P. Publisher: Intercept, Andover, UK, 1993, 415-32.
Ben-Aroya, Shay, et al., "Toward a Comprehensive Temperature-Sensitive Mutant Repository of the Essential Genes of *Saccharomyces cerevisiae*". Molecular Cell. 30, 2008, 248-258.
Bergler, et al., "Sequences of the envM gene and of two mutated alleles in *Escherichia coli*", J Gen Microbiol. Oct. 1992;136(10):2093-100.
Bergler, et al., "The enoyl-[acyl-carrier-protein] reductase (Fabl) of *Escherichia coli*, which catalyzes a key regulatory step in fatty acid biosynthesis, accepts NADH and NADPH as cofactors and is inhibited by palmitoyl-CoA", Eur J Biochem. 242(3), Dec. 15, 1996, 689-94.
Bloch, et al., "Control mechanisms in the synthesis of saturated fatty acids", Annu Rev Biochem. 46, 1977, 263-98.
Bonner, et al., "A core catalytic domain of the TyrA protein family: arogenate dehydrogenase from Synechocystis", Biochem J. 382(Pt 1), Aug. 15, 2004, 279-91.
Bonner, William M., et al., "Purification and Properties of Fatty Acyl Thioesterase I from *Escherichia coli*", J Biol Chem. 247(10), Mar. 25, 1972, 3123-33.
Borgaro, et al. Substrate recognition by B-ketoacyl-ACP synthases. Biochemistry. Dec. 13, 2011; 50(49):10676-86. doi: 10.1021/bi201199x. Epub Nov. 17, 2011.
Bowie, James U., et al., "Deciphering the Message in Protein Sequences: Tolerance to Amino Acid Substitutions", Science 247(4948), Mar. 16, 1990, 1306-10.

Branden, Carl, et al., "Introduction to Protein Structure", Garland Publishing Inc., New York, 1991, 247.
Bressler, et al., "Studies on the mechanism of fatty acid synthesis. XI. The product of the reaction and the role of sulfhydryl groups in the synthesis of fatty acids", J. Biol Chem. vol. 237, May 1962, 1441-1448.
Brock, et al., "Naturally occurring adenines within mRNA coding sequences affect ribosome binding and expression in *Escherichia coli*", J Bacteriol. Jan. 2007;189(2):501-10. Epub Nov. 3, 2006.
Erb, et al., "Carboxylation mechanism and stereochemistry of crotonyl-CoA carboxylase/reductase, a carboxylating enoyl-thioester reductase", Proc Natl Acad Sci U S A. Jun. 2, 2009; 106(22): 8871-8876. Published online May 20, 2009. doi: 10.1073/pnas.0903939106, 8871-8876.
Extended European Search Report dated Mar. 7, 2016 in Patent Application 15182914.0.
Fan, L et al., "Synthesis of medium chain length fatty acid ethyl esters in engineered *Escherichia coli* using endogenously produced medium chain fatty acids", Enzyme and Microbial Technology, vol. 53, No. 2, ISSN 0141-0229, pp. 128-133.
Farmer, et al., "Improving lycopene production in *Escherichia coli* by engineering metabolic control", Nat Biotechnol. May 2000;18(5):533-7.
Felce, Jeremy, et al., "Carbonic Anhydrases Fused to Anion Transporters of the SulP Family Evidence for a Novel Type of Bicarbonate Transporter", J Mol Microbiol Biotechnol. 8(3), 2004, 169-76.
Fernando, et al., "Biorefineries: current status, challenges and future direction", Energ. Fuel. May 2006; 20:1727-1737.
Figge, "Methionine biosynthesis is *Escherichia coli* and Corynebacterium glutamicum", Microbiol Monogro. 2007; 5:163-193.
Fleming, et al., "Extracellular enzyme synthesis in a sporulation-deficient strain of Bacillus licheniformis", Appl Environ Microbiol, Nov. 1995, 61 (11):3775-3780.
Fodor, et al., "Light-Directed, Spatially Addressable Parallel Chemical Synthesis", Science. Feb. 15, 1991;251(4995):767-73.
Fowler, Zachary L., et al., "Increased Malonyl Coenzyme A Biosynthesis by Tuning the *Escherichia coli* Metabolic Network and Its Application to Flavanone Production", Appl Environ Microbiol. 75(18), Sep. 2009, 5831-9.
Fujimoto, et al., "pAM401-Based Shuttle Vectors That Enable Overexpression of Promoterless Genes and One-Step Purification of Tag Fusion Proteins Directly from Enterococcus faecalis", doi: 10.1128/AEM.67.3.1262-1267.2001 Appl. Environ. Microbiol. Mar. 2001 vol. 67 No. 3 1262-1267.
Funa, et al., "A novel quinone-forming monooxygenase family involved in modification of aromatic polyketides", J Biol Chem. Apr. 15, 2005;280(15):14514-23. Epub Feb. 8, 2005.
Gieiz, R. Daniel, et al., "Transformation of Yeast by Lithium Acetate/Single-Stranded Carrier DNA/Polyethylene Glycol Method", Methods Enzymol. 350, 2002, 87-96.
Giladi, et al., "FolM, a new chromosomally encoded dihydrofolate reductase in *Escherichia coli*", J Bacteriol. 185(23), Dec. 2003, 7015-8.
Gilbert, Walter, et al., "Useful Proteins from Recombinant Bacteria", Sci Am. 242(4), Apr. 1980, 74-94.
Gill, et al., "Genome-wide screening for trait conferring genes using DNA microarrays", Proc Natl Acad Sci U S A. May 14, 2002;99(10):7033-8. Epub May 7, 2002.
Ginkel, et al., "Identification and cloning of the *Mycobacterium avium* folA gene, required for dihydrofolate reductase activity", FEMS Microbiology Letters vol. 156, Issue 1, Nov. 1, 1997, 69-78.
Gokarn, et al., "Metabolic analysis of *Escherichia coli* in the presence and absence of the carboxylating enzymes phosphoenolpyruvate carboxylase and pyruvate carboxylase", Appl Environ Microbiol. May 2000;66(5):1844-50.
Goodwin, et al., "Purification and characterization of methylmalonate-semialdehyde dehydrogenase from rat liver. Identity to malonate-semialdehyde dehydrogenase", J Biol Chem. Sep. 5, 1989;264(25):14965-71.
Gray, et al., "Monofunctional chorismate mutase from Bacillus subtilis: purification of the protein, molecular cloning of the gene,

(56) References Cited

OTHER PUBLICATIONS and overexpression of the gene product in *Escherichia coli*", Biochemistry. Jan. 16, 1990;29(2):376-83.
Gronenborn, Bruno, "Overproduction of Phage Lambda Repressor under Control of the lac Promotor of *Escherichia coli*", Mol Gen Genet. 148(3), Nov. 17, 1976, 243-50.
Gu, et al., "Polyketide Decarboxylative Chain Termination Preceded by O-Sulfonation in Curacin A Biosynthesis", J Am Chem Soc. Nov. 11, 2009; 131(44): 16033-16035. doi: 10.1021/ja9071578.
Gulmezian, et al., "Genetic Evidence for an Interaction of the UbiG O-Methyltransferase with UbiX in *Escherichia coli* Coenzyme Q Biosynthesis", J Bacteriol. Sep. 2006;188(17):6435-9.
Guzman, L. M., et al., "Tight regulation, modulation, and high-level expression by vectors containing the arabinose PBAD promoter", J Bacteriol. 177(14), Jul. 1995, 4121-30.
Haldimann, Andreas, et al., "Use of New Methods for Construction of Tightly Regulated Arabinose and Rhamnose Promoter Fusions in Studies of the *Escherichia coli* Phosphate Regulon", J Bacteriol. 180(5), Mar. 1998, 1277-86.
Hall, Neil, et al., "Structure-function analysis of NADPH: nitrate reductase from Aspergillus nidulans: analysis of altered pyridine nucleotide specificity in vivo", Microbiology. 146 (Pt.6), Jun. 2000, 1399-406.
Hatzimanikatis, et al., "Exploring the diversity of complex metabolic networks", Bioinformatics. Apr. 15, 2005;21(8):1603-9. Epub Dec. 21, 2004.
He, et al., "A T42M Substitution in Bacterial 5-Enolpyruvylshikimate-3-phosphate Synthase (EPSPS) Generates Enzymes with Increased Resistance to Glyphosate", Biosci Biotechnol Biochem. vol. 67, 2003—Issue 6, 1405-1409.
Heath, et al. Enoyl-acyl carrier protein reductase (fabI) plays a determinant role in completing cycles of fatty acid elongation in *Escherichia coli* J. Biol Chem. Nov. 3, 1995;270(44):26538-42.
Helge, Jans, et al., "Fatty acid synthesis in *Escherichia coli* and its applications towards the production of fatty acid based biofuels", Biotechnology for Biofuels, vol. 7, No. 1, XP-021173667, Jan. 9, 2014.
Henry, et al., "Discovery of novel routes for the biosynthesis of industrial chemicals: 3¬Hydroxypropanoate. Slides", AICHE Annual Meeting. Nov. 8, 2007. Salt Lake City, UT.
Herter, "Autotrophic CO2 Fixation by Chloroflexus aurantiacus: Study of Glyoxylate Formation and Assimilation via the 3-Hydroxypropionate Cycle", J Bacteriol Jul. 2001;183(14):4305-4316.
Hondorp, et al., "Oxidation of cysteine 645 of cobalamin-independent methionine synthase causes a methionine limitation in *Escherichia coli*", J Bacterio!. May 2009;191(10):3407-10 Epub Mar. 13, 2009.
Hugler, et al., "Malonyl-Coenzyme A Reductase from Chloroflexus aurantiacus, a Key Enzyme of the 3-Hydroxypropionate Cycle for Autotrophic CO2 Fixation", J Bacteriol May 2002;184(9):2404-2410.
Ikuo Miyahisa, et al., "Efficient production of (2S)-flavanones by *Escherichia coli* containing an artificial biosynthetic gene cluster", Applied Microbiology and Biotechnology, Springer, Berlin, DE, (Sep. 1, 2005), vol. 68, No. 4, doi:10.1007/S00253-005-1916-3, ISSN 1432-0614, pp. 498-504, XP019331939.
International search report and written opinion dated Feb. 4, 2015 for PCT/US2014/047320.
Ivanova, et al., "Genome sequence of Bacillus cereus and comparative analysis with Bacillus anthracis", Nature. May 1, 2003;423(6935):87-91.
James, Ethan S., et al., "Expression of two *Escherichia coli* acetyl-CoA carboxylase subunits is autoregulated", J. Biol Chem. 279(4), Jan. 23, 2004, 2520-7.
Jan Podkowinski, et al., "OPINIONS Acetyl-coenzyme A carboxylase—an attractive enzyme for biotechnology", Biotechnology, PL, (Jan. 1, 2011), vol. 4, doi:10.5114/bta.2011.46549, ISSN 0860-7796, pp. 321-335, XP055303418.
Jenkins, et al., "Genetic and molecular characterization of the genes involved in short-chain fatty acid degradation in *Escherichia coli*: the ato system", J Bacteriol. Jan. 1987; 169(1): 42-52.
Jiang, et al., "Biosynthetic pathways for 3-hydroxypropionic acid production", Appl Microbiol Biotechnol. Apr. 2009;82(6):995-1003.
Jing, et al., "Phylogenetic and experimental characterization of an acyl-ACP thioesterase family reveals significant diversity in enzymatic specificity and activity", BMC Biochemistry201112:44. https://doi.org/10.1186/1471-2091-12-44.
Joike, et al., "Amino acid substitutions affecting catalytic activity and subunit interactions of aminodeoxychorismate synthase in *E. coli*", Abstracts of the General Meeting of the American Society for Microbiology. 2002; 102:275-276, and 102nd General Meeting of the American Society for Microbiology; Salt Lake, UT, USA; May 19-23, 2002.
Juliano Alves, et al., "Cloning, expression, and enzymatic activity ofandacetyl-coenzyme A carboxylases", Analytical Biochemistry, Academic Press Inc, New York, vol. 417, No. 1, doi:10.1016/J.AB. 2011.05.041, ISSN 0003-2697, (May 25, 2011), pp. 103-111, (Jun. 1, 2011), XP028245778.
Jung, et al., "Jung et al., Wax-deficient antherl is involved in cuticle and wax production in rice anther walls and is required for pollen development", and is required for pollen development, Plant Cell, Nov. 2006, vol. 18, No. 11, pp. 3015-3032.
Kapol, et al., "Purification and characterization of 2-oxoglutarate decarboxylase of Leuconostoc oenos", Journal of General Microbiology 136 (1990), 1497-1499.
Katavic, et al. Alternation of seed fatty acid composition by an ethyl methanesulfonate-induced mutation in *Arabidopsis thaliana* affecting diacylglycerol acyltransferase activity. Plant Physiol. May 1995; 108(1):399-409.
Katsuyama, Yohei, et al., "Production of curcuminoids by *Escherichia coli* carrying an artificial biosynthesis pathway", Microbiology. 154(Pt9), Sep. 2008, 2620-8.
Kern, et al., "Engineering primary metabolic pathways of industrial micro-organisms", J Biotechnol. Mar. 30, 2007;129(1):6-29. Epub Dec. 2, 2006.
Kiatpapan, Pornpimon, et al., "Molecular Characterization of Lactobacillus plantarum Genes for B-Ketoacyl-Acyl Carrier Protein Synthase III (fabH) and Acetyl Coenzyme A Carboxylase (accBCDA), Which Are Essential for Fatty Acid Biosynthesis", Appl Environ Microbiol. 67(1), Jan. 2001, 426-33.
Kim, et al., "Effect of Overexpression of Actinobacillus succinogenes Phosphoenolpyruvate Carboxykinase on Succinate Production in *Escherichia coli*", Appl. Environ. Microbiol. vol. 70 No. 2, Feb. 2004, 1238-1241.
Kim, Joong Kyun, et al., "Extractive Recovery of Products from Fermentation Broths", Biotechnol. Bioprocess Eng, 4, 1999, 1-11.
Kim, Kwang-Seo, et al., "The Rut Pathway for Pyrimidine Degradation: Novel Chemistry and Toxicity Problems", J Bacteriol. 192(16), Aug. 2010, 4089-102.
Kim, Youngnyun, et al., "Construction of an *Escherichia coli* K-12 Mutant for Homoethanologenic Fermentation of Glucose or Xylose without Foreign Genes", Appl Environ Microbiol. 73(6), Mar. 2007, 1766-71.
Kim, Youngnyun, et al., "Dihydrolipoamide Dehydrogenase Mutation Alters the NADH Sensitivity of Pyruvate Dehydrogenase Complex of *Escherichia coli* K-12", J Bacteriol. 190(11), Jun. 2008, 3851-8.
Kimchi-Sarfaty, et al., "A "Silent" Polymorphism in the MDR1 Gene Changes Substrate Specificity", Science. Science 315(5811):, Jan. 26, 2007, 525-8.
Kinney. Manipulating flux through plant metabolic pathways. Curr Opinion Plant Biol. Apr. 1998;1(2):173-8.
Kisselev, "Polypeptide Release Factors in Prokaryotes and Eukaryotes: Same Function, Different Structure", Structure. 10(1), Jan. 2002, 8-9.
Kizer, Lance, et al., "Application of Functional Genomics to Pathway Optimization for Increased Isoprenoid Production", Appl Environ Microbiol. 74(10), May 2008, 3229-41.
Kleerebezem, et al., "Controlled gene expression systems for lactic acid bacteria: transferable nisin-inducible expression cassettes for

(56) References Cited

OTHER PUBLICATIONS

Lactococcus, Leuconostoc, and Lactobacillus spp", Appl Environ Microbiol. Nov. 1997;63(11):4581-4584.

Kleerebezem, et al., "The qmeA (ts) mutation of *Escherichia coli* is localized in the fabl gene, which encodes enoyl-ACP reductase.", Res Microbiol. 147(8), Oct. 1996, 609-13.

Knothe, Gerhard, et al., "Biodiesel and renewable diesel: A comparison", Progress in Energy and Combustion Science. vol. 36, No. 3 XP026919218, Jun. 1, 2010, 364-373.

Kozliak, et al., "Expression of proteins encoded by the *Escherichia coli* cyn operon: carbon dioxide-enhanced degradation of carbonic anhydrase", J Bacteriol. 176(18), Sep. 1994, 5711-7.

Kozliak, et al., "Role of bicarbonate/CO2 in the inhibition of *Escherichia coli* growth by cyanate", J. Bacteriol. vol. 177 No. 11, Jun. 1995, 3213-3219.

Kroeger, Jasmin K., et al., "A spectrophotometric assay for measuring acetyl-coenzyme A carboxylase", Anal Biochem. 411(1), Apr. 1, 2011, 100-5.

Kunin, et al. A comparative analysis of the inventive step standard in the European and Japanese patent office from an US perspective. IP Litigator. Jan./Feb. 2008; 15-23.

Kurcok, et al., "Reactions of l3-lactones with potassium alkoxides and their complexes with 18-crown-6 in aprotic solvents", Journal of Organic Chemistry. 58(16), 1993, 4219-4220.

Kwon, et al., "A physiology study of *Escherichia coli* overexpressing phosphoenolpyruvate carboxykinase", Biosci. Biotechnol. Biochem., 72 (4), 2008, 1138-1141.

Kwon, et al., "Influence of gluconeogenic phosphoenolpyruvate carboxykinase (PCK) expression on succinic acid fermentation in *Escherichia coli* under high bicarbonate condition", Journal of Microbiology and Biotechnology 16(9)., Sep. 2006, 1448-1452.

Lambert, et al., "Cre-lox-Based System for Multiple Gene Deletions and Selectable-Marker Removal in Lactobacillus plantarum", AEM, vol. 73, No. 4, Jan. 1, 1900, 1126-1135.

Lan, El e Liao, JC "ATP drives direct photosynthetic production of 1-butanol in cyanobacteria", Proceedings of the National Academy of Sciences, vol. 109, No. 16, ISSN 0027-8424, pp. 6018-6023.

Lan, El e Liao, JC "Microbial synthesis of n-butanol, isobutanol, and other higher alcohols from diverse resources", Bioresource Technology, , vol. 135, ISSN 0960-8524, pp. 339-349.

Langlois, et al., "A new preparation of liinuoromethanesulfinate salts", Journal of Fluorine Chemistry. 128(7), 2007, 851-856.

Lardizabal, KD et al., "Purification of a Jojoba Embryo Wax Synthase, Cloning of its CDNA, and Production of High Levels of Wax in Seeds of Transgenic *Arabidopsis*", Plant Physiology, vol. 122, No. 3, ISSN 0032-0889, pp. 645-655.

Lassner, Michael W., et al., "Lysophosphatidic Acid Acyltransferase from Meadowfoam Mediates Insertion of Erucic Acid at the sn-2 Position of Triacylglycerols in Transgenic Rapeseed Oil", Plant Physiol. 109(4), Dec. 1995, 1389-94.

Lee, et al. Fatty acid synthesis by elongases in trypanosomes. Cell. Aug. 25, 2006;126(4):691-9.

Lee, S et al., "Correlations between FAS elongation cycle genes expression and fatty acid production for improvement of long-chain fatty acids in *Escherichia coli*", Applied Biochemistry and Biotechnology, vol. 169, No. 5, ISSN 1559-0291, pp. 1606-1619.

Leeper, Stephen A., "Membrane Separations in the Recovery of Biofuels and Biochemicals: An Update Review", Separation and Purification Technology, Norman N. Li and Joseph M. Calo, Eds., Marcel Dekker, 1992, 99-194.

Lennen, et al., "A process for microbial hydrocarbon synthesis: Overproduction of fatty acids in *Escherichia coli* and catalytic conversion to alkanes", Biotechnol Bioeng. vol. 106, Issue 2, Jun. 1, 2010, 193-202.

Lennen, RM e Pfleger, BF "Engineering *Escherichia coli* to synthesize free fatty acids", Trends in Biotechnology, vol. 30, No. 12, ISSN 0167-7799, pp. 659-667.

Lennen, RM et al., "Microbial production of fatty acid-derived fuels and chemicals", Current Opinion in Biotechnology., vol. 24, No. 6, ISSN 0958-1669, pp. 1044-1053. Epub Mar. 28, 2013.

Leonard, Effendi, et al., "Engineering Central Metabolic Pathways for High-Level Flavonoid Production in *Escherichia coli*", Appl Environ Microbiol. 73(12), Jun. 2007, 3877-86.

Li, et al., "Effect of poxB gene knockout on metabolism in *Escherichia coli* based on growth characteristics and enzyme activities", World Journal of Microbiology and Biotechnology. vol. 23, Issue 4, Apr. 2007, 573-580.

Li, Jianguo, et al., "Chronic intermittent hypoxia upregulates genes of lipid biosynthesis in obese mice", J Appl Physiol. 99(5), Nov. 2005, 1643-8.

Li, Wang, et al., "Characterization of two temperature-inducible promoters newly isolated from B. subtilis", Biochem Biophys Res Commun. 358(4), Jul. 13, 2007, 1148-53.

Liang, et al., "Fe2(SO4)3.4H2O/concentrated H2SO4: an efficient catalyst for esterification", Journal of Chemical Research, Synopses. 3, 2004, 226-227.

Lilly, Mariska, et al., "The effect of increased yeast alcohol acetyltransferase and esterase activity on the flavour profiles of wine and distillates", Yeast. 23(9), Jul. 15, 2006, 641-59.

Lioa, et al., "Metabolic engineering for a malonyl-CoA-dependent pathway for fatty acid production in *Escherichia coli* (abstract)", SIMB Annual Meeting & Exhibition. Aug. 12-16, 2012. Washington Hilton, Washington, DC. Available at http://sim.confex.com/sim/2012/webprogram/Paper23197.html, Aug. 2012.

Lipscomb, et al., "Poster—Understanding production of 3-Hydroxypropionic Acid (3¬HP) in a genomic context.", OPX Biotechnologies. Metabolic Engineering, Sep. 17, 2008.

Lu, Xuefeng, et al., "Overproduction of free fatty acids in *E. coli*: Implications for biodiesel production", Metab Eng. 10(6), Nov. 2008, 333-9.

Lutke-Eversloh, et al., "Feedback inhibition of chorismate mutase/prephenate dehydrogenase (TyrA) of *Escherichia coli*: generation and characterization of tyrosine-insensitive mutants", Appl Environ Microbiol. vol. 71 No. 11, Nov. 2005, 7224-8.

Lynch, "Rapid optimization of microorganisms for the cost superior production of chemicals & fuels", OPX Biotechnologies, Sep. 15, 2008.

Lynch, M., et al., "SCALEs: multiscale analysis of library enrichment. Nat Methods", Nat Methods. 4(1)., Jan. 2007, 87-93.

Machado, et al., "A selection platform for carbon chain elongation using the CoA-dependent pathway to produce linear higher alcohols", Metabolic Eng. 2012, 14, 504-11.

Magnuson, Kelly, et al., "Regulation of fatty acid biosynthesis in *Escherichia coli*", Microbiological Reviews, vol. 57, No. 3, 1993, 522-542.

Mandaokar, Ajin, et al., "Transcriptional regulators of stamen development in *Arabidopsis* identified by transcriptional profiling", Plant J. 46(6), Jun. 2006, 984-1008.

Martin, et al., "Engineering a mevalonate pathway in *Escherichia coli* for production of terpenoids", Nat Biotechnol. 21(7)., Jul. 2003, 796-802.

Masayuki, et al., "Expression of Clostridium acetobutylicum butanol synthetic genes in *Escherichia coli*", Applied Microbiology and Biotechnology, Jan. 2008, vol. 77, Issue 6, pp. 1305-1316.

McCabe, Warren L., et al., "Unit Operations of Chemical Engineering", 5th Ed., W.L. McGraw Hill, New York, 1993.

Meades, Glen, et al., "A tale of two functions: enzymatic activity and translational repression by carboxyltransferase", Nucleic Acids Res. 38(4), Mar. 2010, 1217-27.

Brock, Thomas D., "Biotechnology: A Textbook of Industrial Microbiology", Second Edition Sinauer Associates, Inc. Sunderland, Mass., 1989.

Brosius, Jurgen, et al., "Spacing of the -10 and -35 Regions in the tac Promoter. Effect on its in vivo activity", J Biol Chem. 260(6), Mar. 25, 1985, 3539-41.

Broun, Pierre, et al., "Catalytic Plasticity of Fatty Acid Modification Enzymes Underlying Chemical Diversity of Plant Lipids", Science. 282(5392), Nov. 13, 1998, 1315-7.

Brown, et al., "Synthesis of labeled acrylamide and N-methylolacrylamide (NMA): 15N-acrylamide, 13C-NMA, 15N-NMA, and 13C,15N-NMA", Journal of labelled compounds & radiopharmaceuticals. 48(14):1031-1039., Nov. 14, 2005.

(56) References Cited

OTHER PUBLICATIONS

Brutlag, Douglas L., et al., "Improved sensitivity of biological sequence database searches", Comput Appl Biosei. 6(3), Mar. 25, 1990, 237-45.
Bunch, et al., "The ldhA gene encoding the fermentative lactate dehydrogenase of *Escherichia coli*", Microbiology Jan. 1997; 143 (Pt 1):187-95.
Canada, et al., "Directed evolution of toluene ortho-monooxygenase for enhanced 1 ¬naphthol synthesis and chlorinated ethene degradation", J Bacteriol. Jan. 2002;184(2):344-9.
Chang, et al., "Acetate metabolism in a pta mutant of *Escherichia coli* W3110: importance of maintaining acetyl coenzyme A flux for growth and survival", J Bacteriol. Nov. 1999;181(21):6656-63.
Chang, et al., "Probable polyketide synthase/thioesterase. NCBI Direct Submission, Accession No. GI50082961", Jun. 14, 2004.
Chao, et al., "Selective production of L-aspartic acid and L-phenylalanine by coupling reactions of aspartase and aminotransferase in *Escherichia coli*", Enzyme Microb Technol. 27(1-2), Jul. 19-25, 2000.
Cheng, et al., "Mammalian wax biosynthesis: I. Identification of two fatty acyl-Coenzyme A reductases with different substrate specificities and tissue distributions", Journal of Biological Chemistry, Sep. 3, 2004, vol. 279, No. 36, pp. 37789-37797.
Chica, Roberto A., et al., "Semi-rational approaches to engineering enzyme activity: combining the benefits of directed evolution and rational design", Curr Opin Biotechnol. 16(4), Aug. 2005, 378-84.
Cho, et al., "Simultaneous synthesis of enantiomerically pure (S)-amino acids and (R)¬namines using coupled transaminase reactions", Biotechnol Bioeng Mar. 30, 2003;81(7):783-9.
Choi-Rhee, Eunjoo, et al., "The Biotin Carboxylase-Biotin Carboxyl Carrier Protein Complex of *Escherichia coli* Acetyl-CoA Carboxylase", J Biol Chem. 278(33), Aug. 15, 2003, 30806-12.
Chotani, et al., "The commercial production of chemicals using pathway engineering", Biochim Biophys Acta. Dec. 29, 2000;1543(2):434-455.
Cleusix, et al., "Inhibitory activity spectrum of reuterin produced by Lactobacillus reuteri against intestinal bacteria", BMC Microbiology, 7: 101, Nov. 12, 2007, 9 Pages.
Coleman, Rosalind A., et al., "Enzymes of triacylglycerol synthesis and their regulation", Prog Lipid Res. 43(2), Mar. 2004, 134-76.
Cowan, Peter J., et al., "Characterization of the Major Promoter for the Plasmid-Encoded Sucrose Genes scrY, scrA, and scrB", J Bacteriol. 173(23), Dec. 1991, 7464-70.
Crameri, et al., "DNA shuffling of a family of genes from diverse species accelerates directed evolution", Nature. Jan. 15, 1998;391(6664):288-91.
Cronan, et al., "Genetic and biochemical analyses of pantothenate biosynthesis in *Escherichia coli* and *Salmonella typhimurium*.", J Bacteriol. Mar. 1982;149(3):916-22.
Cronan, J.E, "Beta-Alanine Synthesis in *Escherichia coli*", J Bacteriol. Mar. 1980;141(3):1291-7.
Cronk, et al. "Cloning, crystallization and preliminary characterization of a beta-carbonic anhydrase from *Escherichia coli*", Acta Crystallogr D Biol Crystallogr. Sep. 2000;56(Pt 9):1176-9.
Daley, Daniel O., et al., "Global Topology Analysis of the *Escherichia coli* Inner Membrane Proteome", Science, 308 (5726), May 27, 2005, 1321-3.
Daniel, Jaiyanth, et al., "Induction of a Novel Class of Diacylglycerol Acyltransferases and Triacylglycerol Accumulation in *Mycobacterium tuberculosis* as it Goes into a Dormancy-Like State in Culture", J Bacteriol. 186(15), Mar. 2004, 5017-30.
Daruwala, et al., "Menaquinone (vitamin K2) biosynthesis: overexpression, purification, and characterization of a new isochorismate synthase from *Escherichia coli*", J. Bacteriol. 179(10), May 1997, 3133-8.
Datsenko, Kirill A., et al., "One-step inactivation of chromosomal genes in *Escherichia coli* K-12 using PCR products". Proc Natl Acad Sci USA. 97(12), Jun. 6, 2000, 6640-5.
Datta, Simanti, et al., "A set of recombineering plasmids for gram-negative bacteria", Gene. 379, Sep. 1, 2006, 109-15.

Davis, Mark S., et al., "Overproduction of Acetyl-CoA Carboxylase Activity Increases the Rate of Fatty Acid Biosynthesis in *Escherichia coli*", The Journal of Biological Chemistry (2000), vol. 275, pp. 28593-28598, 2000, 28593-28598.
De Boer, Herman A., et al., "The tac promoter: A functional hybrid derived from the trp and lac promoters", Proc Natl Acad Sci USA. 80(1), Jan. 1983, 21-5.
De Mendoza, et al., "Thermal regulation of membrane lipid fluidity in bacteria", Trends Biochem. Sci. 1983; 8:49-52.
Dell'Aquila, et al., "Acid-base balance in peritoneal dialysis", J Nephrol. Mar.-Apr. 2006;19 Suppl 9:S104-7.
Dellomonaco, et al., "Engineered reversal of the β-oxidation cycle for the synthesis of fuels and chemicals", Nature Aug. 18, 2011, 476 (7360): 355-9.
Dellomonaco, C et al., "Engineered reversal of the [beta]-oxidation cycle for the synthesis of fuels and chemicals—supplementary information", Nature, vol. 476, No. 7360, ISSN 0028-0836, pp. 355-359.
Dellomonaco, C et al., "Engineered reversal of the [beta]-oxidation cycle for the synthesis of fuels and chemicals", Nature, vol. 476, No. 7360, ISSN 0028-0836, pp. 355-359.
Demmer, Ulrike, et al., "Structural Basis for a Bispecific NADP and CoA Binding Site in an Archaeal Malonyl-Coenzyme A Reductase", J Biol Chem. 288(9), Mar. 1, 1990, 6363-70.
Den, et al., "Enzymatic Conversion of l3-Hydroxypropionate to Malonic Semialdehyde*", J Biol Chem Jul. 1959;234(7):1666-1671.
Denic, et al., "A Molecular Caliper Mechanism for Determining Very Long-Chain Fatty Acid Length", vol. 130, Issue 4, Aug. 24, 2007, Aug. 24, 2007, 663-377.
Deshpande, Mukund V., "Ethanol Production from Cellulose by Coupled Saccharification/Fermentation using *Saccharomyces cerevisiae* and Cellulase Complex from Sclerotium rolfsii UV-8 Mutant", Appl Biochem Biotechnol. 36(3), 1992, 227-34.
Devos, Damien, et al., "Practical Limits of Function Prediction", Proteins. 41(1), Oct. 1, 2000, 98-107.
Dewick, P., "Chapter 4. The Shikimate Pathway: Aromatic Amino Acids and Phenylpropanoids", Medicinal Natural Products: A Biosynthetic Approach, Second Edition (2002): 121-166.
Diaz, et al., "Characterization of the hca cluster encoding the dioxygenolytic pathway for initial catabolism of 3-phenylpropionic acid in *Escherichia coli* K-12", J Bacteriol. Jun. 1998;180(11):2915-23.
Dittrich, Franziska, et al., "Fatty acid elongation in yeast. Biochemical characteristics of the enzyme system and isolation of elongation-defective mutants", Eur J Biochem. 252(3), Mar. 15, 1998, 477-85.
Dohr, Olaf, et al., "Engineering of a functional human NADH-dependent cytochrome P450 system", Proc Natl Acad Sci USA. 98(1), Jan. 2, 2001, 81-6.
Doroshenko, Vera G., et al., "Pho regulon promoter-mediated transcription of the key pathway gene aroGFbr improves the performance of an L-phenylalanine-producing *Escherichia coli* strain", Applied Microbiology and Biotechnology 88, 2010, 1287-1295.
Drake, et al., "Structure of the EntB Multidomain Nonribosomal Peptide Synthetase and Functional Analysis of Its Interaction with the EntE Adenylation Domain", Chem Biol. Apr. 2006;13(4):409-19.
Duncan, et al., "Lactate-utilizing bacteria, isolated from human feces, that produce butyrate as a major fermentation product", Appl Environ Microbiol. Oct. 2004;70(10):5810-7.
Duncan, et al., "The overexpression and complete amino acid sequence of *Escherichia coli* 3-dehydroquinase", Biochem J. Sep. 1, 1986;238(2):475-83.
Elvin, Christopher M., et al., "Modified bacteriophage lambda promoter vectors for overproduction of proteins in *Escherichia coli*", Gene. 87(1), Mar. 1, 1990, 123-6.
Eppink, Michel H. M., et al., "Switch of Coenzyme Specificity of p-Hydroxybenzoate Hydroxylase", J Mol Biol. 292(1), Sep. 10, 1999, 87-96.

(56) References Cited

OTHER PUBLICATIONS

Epstein, et al., "Oil: A Life Cycle Analysis of its Health and Environmental Impacts", The Center for Health and the Global Environment, Harvard Medical School. Mar. 2002. www.med.harvard.edu/chge/oil.html.

Shelden, Megan C., et al., "Membrane topology of the cyanobacterial bicarbonate transporter, BicA, a member of the SulP (SLC26A) family", Molecular Membrane Biology vol. 27(1), 2010, 12-22.

Singh, et al., "Genes restoring redox balance in fermentation-deficient E. coli NZN111", Metabolic Engineering. vol. 11, Issue 6, Nov. 2009, 347-354.

Singh, Raushan Kumar, et al., "Protein Engineering Approaches in the Post-Genomic Era", Curr Protein Pept Sci. 18, 2017, 1-11.

Skerra, Arne, "Use of the tetracycline promoter for the tightly regulated production of a murine antibody fragment in Escherichia coli", Gene. 151(1-2), Dec. 30, 1994, 131-5.

Smirnova, N et al., Engineered Fatty Acid Biosynthesis by Altered Catalytic Function of b-Ketoacyl-Acyl Carrier Protein Synthase III. Journal of Bacteriology, Apr. 2001, vol. 183, No. 7, pp. 2335-2342.

Sousa, Silvino, et al., "The ARO4 gene of Candida albicans encodes a tyrosine-sensitive DAHP synthase: evolution, functional conservation and phenotype of Aro3p-, Aro4p-deficient mutants", Microbiology 148(Pt5), 2002, 1291-1303.

Stephanie C. Weatherly, "Expression and characterization of recombinant fungal acetyl-CoA carboxylase and isolation of a soraphen-binding domain", Biochemical Journal, GB, (May 15, 2004), vol. 380, No. 1, doi:10.1042/bj20031960, ISSN 0264-6021, pp. 105-110, XP055302533, May 15, 2004.

Stephanopoulos, et al., "Challenges in engineering microbes for biofuels production", Science. 315(5813), Feb. 9, 2007, 801-4.

Stephanopoulos, et al., "Network Rigidity and Metabolic Engineering in Metabolite Overproduction", Science. 252(5013), Jun. 21, 1991, 1675-81.

Stephens, et al., "Mitochondrial fatty acid synthesis in Trypanosoma brucei", Journal of Biological Chemistry, vol. 282, No. 7, Feb. 16, 2007, 4427-36.

Stim, et al., "Nucleotide sequence of the adi gene, which encodes the biodegradative acid-induced arginine decarboxylase of Escherichia coli", J Bacteriol. 175(5), Mar. 1993, 1221-34.

Stone, Scot J., et al., "Lipids and Lipoproteins: Lipopenia and Skin Barrier Abnormalities in DGAT2-deficient Mice", J Biol Chem. 279(12), Mar. 19, 2004, 11767-76.

Straathoff, et al., "Feasibility of acrylic acid production by fermentation", Appl Microbiol Biotechnol.67(6), Jun. 2005, 727-34.

Strauss, et al., "Enzymes of a novel autotrophic CO2 fixation pathway in the phototrophic bacterium Chloroflexus aurantiacus, the 3-hydroxypropionate cycle", Eur J Biochem. 215(3), Aug. 1, 1993, 633-43.

Stryer. Biochemistry 4th Ed. Freeman and Co., New York. 1995; 463-650.

Studier, William F., et al., "Use of Bacteriophage T7 RNA Polymerase to Direct Selective High-level Expression of Cloned Genes", J Mol Biol. 189(1), May 5, 1900, 113-30.

Subrahmanyam, Satyanarayana, et al., "Overproduction of a Functional Fatty Acid Biosynthetic Enzyme Blocks Fatty Acid Synthesis in Escherichia coli", J Bacteriol. 180(17), Sep. 1998, 4596-602.

Suh, et al. Cuticular lipid composition, surface structure, and gene expression in Arabidopsis stem epidermis. Plant Physiol. Dec. 2005; 139(4):1649-65. Epub Nov. 18, 2005.

Sulter, G. J., et al., "Proliferation and metabolic significance of peroxisomes in Candida boidinii during growth on D-alanine or oleic acid as the sole carbon source", Arch Microbiol. 153(5), 1990, 485-9.

Sun, et al., "ZrOC12 x 8H20: an efficient, cheap and reusable catalyst for the esterification of acrylic acid and other carboxylic acids with equimolar amounts of alcohols", Molecules. 11(4):, Apr. 10, 2006, 263-71.

Taghavi, et al., "Electroporation of Alcaligenes eutrophus with (mega) plasmids and genomic DNA fragments", Appl Environ Microbiol. Oct. 1994; 60(10): 3585-3591.

Takamizawa, et al., "Beta-Hydroxypropionic Acid Production by Byssochlamys Sp. Grown on Acrylic Acid", Appl Microbiol Biotechnol. 40, 1993, 196-200.

Takamura, et al., "Changes in the intracellular concentration of acetyl-CoA and malonyl-CoA in relation to the carbon and energy metabolism of Escherichia coli K12", J Gen Microbiol 134(8), Aug. 1988, 2249-53.

Tanimoto, et al., "Analysis of the Conjugal Transfer System of the Pheromone—Independent Highly Transferable Enterococcus Plasmid pMG1: Identification of a tra Gene (traA) Up-Regulated during Conjugation", doi: 10.1128/JB.184.20.5800-5804.2002 J. Bacteriol. Oct. 2002 vol. 184 No. 20 5800-5804.

Tian, et al., "*Mycobacterium tuberculosis* appears to lack an alpha-ketoglutarate dehydrogenase and encodes pyruvate dehydrogenase in widely separated genes", Mol Microbiol. 57(3), Aug. 2005, 859-68.

Tian, et al., "Variant tricarboxylic acid cycle in *Mycobacterium tuberculosis*: Identification of alpha-ketoglutarate decarboxylase". Proc Natl Acad Sci U S A. 102(30), Jul. 26, 2005, 10670-5.

Tomar, A., "Master Thesis. Production of Pyruvate by *Escherichia coli* Using Metabolic Engineering", The University of Georgia, May 2002, 1-171.

Tunnicliff, et al., "The inhibition by substrate analogues of gamma-aminobutyrate aminotransferase from mitochondria of different subcellular fractions of rat brain", Can J Biochem. 55(4), Apr. 1977, 479-84.

Turlin, et al., "3-phenylpropionate catabolism and the *Escherichia coli* oxidative stress response", Res Microbiol. 156(3), Apr. 2005, 312-21.

UniProt Acinetobacter tjembergiae DSM 14971, 3-oxoacyl-[acyl-carrier-protein] synthase, ID:V2UVU7_9GAMM, deposited Jan. 22, 2014, Retrieved from <https:??www.uniprot.org/uniprot/V2UVU7> on Apr. 2, 2021.

Valentin H E, et al., "Production of poly(3-hydroxybutyrate-co-4-hydroxybutyrate) in recombinant *Escherichia coli* grown on glucose", Journal of Biotechnology, Elsevier Science Publishers, Amsterdam, NL. Elsevier Science Publishers, Amsterdam, NL, vol. 58, No. 1, doi:10.1016/S0168-1656(97)00127-2, ISSN 0168-1656, XP004126101, Oct. 2, 1997, 33-38.

Van Kranenburg, et al., "Functional Analysis of Three Plasmids from Lactobacillus plantarum", doi: 10.1128/AEM.71.3.1223-1230. 2005 Appl. Environ. Microbiol. Mar. 2005 vol. 71 No. 3 1223-1230.

Vedantam, et al., "Characterization of mutations contributing to sulfathiazole resistance in *Escherichia coli*", Antimicrob Agents Chemother. 42(1), Jan. 1998, 88-93.

Vilcheze, et al., "Inactivation of the inhA-Encoded Fatty Acid Synthase II (FasII) Enoyl-Acyl Carrier Protein Reductase Induces Accumulation of the FASI End Products and Cell Lysis of *Mycobacterium smegmatis*", doi: 10.1128/JB.182.14.4059-4067. 2000 J. Bacteriol. vol. 182 No. 14, Jul. 2000, 4059-4067.

Wankat, Phillip C., "Separation Process Engineering, Equilibrium Staged Separations", P.C. Wankat, Prentice Hall, Englewood Cliffs. NJ. USA., 1988.

Warnecke, et al., "A genomics approach to improve the analysis and design of strain selections", Metab Eng. 10(3-4), May-Jul. 2008, 154-65.

Warnecke, et al., "Engineering of Organic Acid Tolerance Genes in *E. coli* for Biorefinery Applications", 2006 AIChE Annual meeting in San Francisco, California, Nov. 12-17, 2006, https://aiche.confex.comlaiche/2006/techprogram/P67122.HTM.

Warnecke, et al., "Identification of a 21 amino acid peptide conferring 3¬hydroxypropionic acid stress-tolerance to *Escherichia coli*", Biotechnol Bioeng.109(5). doi: 10.1002/bit.24398., May 2012, 1347-52.

Warnecke, et al., "Organic acid toxicity, tolerance, and production in *Escherichia coli* biorefining applications.", Microbial Cell Factories. 4(25), 2005, 1-8.

Warnecke, et al., "Rapid dissection of a complex phenotype through genomic-scale mapping of fitness altering genes", Metab Eng. 12(3), May 2010, 241-50.

Wasewar, et al., "Fermentation of Glucose to Lactic Acid Coupled with Reactive Extraction: A Review.", Ind. Eng. Chem. Res. 43, 2004, 5969-5982.

(56) References Cited

OTHER PUBLICATIONS

Waterson, et al., "Enoyl coenzyme A hydratase (crotonase). Catalytic properties of crotonase and its possible regulatory role in fatty acid oxidation", J Biol Chem. 247(16), Aug. 25, 1972, 5258-65.

Weilbacher, et al., "A novel sRNA component of the carbon storage regulatory system of *Escherichia coli*", Molecular Microbiology, vol. 48, No. 3, [online] [Retrieved on Jul. 11, 2007]. [Retrieved from the internet: http://www.blackwell-synergy.com/links/doi/10.1046/1.1365-2958.2003.03459.x/full/], May 2003, 657-670.

Welch, et al., "Extensive mosaic structure revealed by the complete genome sequence of uropathogenic *Escherichia coli*.", Proc Natl Acad Sci U S A. 99(26), Dec. 24, 2002, 17020-4.

Werpy, et al., "Top Value Added Chemicals From Biomass, vol. 1—Results of Screening for Potential candidates From Sugars and Synthesis Gas", Pacific Northwest National Laboratory. U.S. Department of Energy, Aug. 2004.

Whisstock, et al., "Prediction of protein function from protein sequence and structure", Q Rev Biophys. 36(3), Aug. 2003, 307-40.

White, et al., "The overexpression, purification and complete amino acid sequence of chorismate synthase from *Escherichia coli* K12 and its comparison with the enzyme from Neurospora crassa", Biochem J. 251(2), Apr. 15, 1988, 313-22.

Winkler, Christoph K., et al., "Asymmetric bioreduction of activated alkenes to industrially relevant optically active compounds", J Biotechnol. 162(4), Dec. 31, 2012, 381-9.

Wishart, et al., "A single mutation converts a novel phosphotyrosine binding domain into a dual-specificity phosphatase", J Biol Chem. 270(45), Nov. 10, 1995, 26782-5.

Abdel-Hamid et al., "Pyruvate oxidase contributes to the aerobic growth efficiency of *Escherichia coli*," Microbiology, 2001, 147(Pt 6):11483-1498.

Antonenkov et al., "Substrate Specificities of 3-Oxoacyl-CoA Thiolase A and Sterol Carrier Protein 2/3-Oxoacyl-CoA Thiolase Purified from Normal Rat Liver Peroxisomes," J. Biol. Chem., 1997, 272 (41):P26023-26031.

Chang et al., "Genetic and biochemical analyses of Escherichia coli strains having a mutation in the structural gene (poxB) for pyruvate oxidase," J Bacteriol, 1983, 154(2):1756-62.

Choi et al., "beta-ketoacyl-acyl carrier protein synthase III (FabH) is a determining factor in branched-chain fatty acid biosynthesis," J Bacteriol. Jan. 2000;182(2):1365-70.

Heath et al., "Lipid biosynthesis as a target for antibacterial agents," Prog. Lipid Res, 2001 40(6):1467-497.

Khandekar et al., "Identification, Substrate Specificity, and Inhibition of theStreptococcus pneumoniae p. Ketoacyl-Acyl Carrier Protein Synthase III (FabH)*," J. Biol. Chem., 276:32, P30024-30030 2001.

Mat-Jan et al., "Mutants of *Escherichia coli* deficient in the fermentative lactate dehydrogenase," J Bacteriol. 1989, 171 (1):342-8.

McCue et al.,"Phylogenetic footprinting of transcription factor binding sites in proteobacterial genomes," Nucleic Acids Res., 29(3):774-82, 2001.

Oui et al., "Crystal structure and substrate specificity of the beta-ketoacyl-acyl carrier protein synthase III (FabH) from *Staphylococcus aureus*," Protein Science (2005), 14:2087-2094.

Zhang et al., "The FabR (YijC) Transcription Factor Regulates Unsaturated Fatty Acid Biosynthesis in *Escherichia coli*," J. Biol. Chem. 277 (18):15558-65, 2002.

\* cited by examiner

GENETICALLY MODIFIED CELLS THAT PRODUCE C6-C10 FATTY ACID DERIVATIVES

CROSS REFERENCE TO RELATED APPLICATIONS

This application is a national phase application of International Application No. PCT/US2018/016394, filed Feb. 1, 2018, entitled GENETICALLY MODIFIED CELLS THAT PRODUCE C6-C10 FATTY ACID DERIVATIVES, which claims the benefit of U.S. Provisional Patent Application No. 62/453,817, filed Feb. 2, 2017, entitled GENETICALLY MODIFIED CELLS THAT PRODUCE C6-C10 FATTY ACID DERIVATIVES, each of which is hereby incorporated by reference in its entirety.

This work was supported by the United States Department of Energy under contract no. DE-EE0070007. The United States Government has certain rights to this invention.

REFERENCE TO A SEQUENCE LISTING SUBMITTED VIA EFS-WEB

The content of the ASCII text file of the sequence listing named "N00513-WO-PCT-20180530_SeqList_ST25.txt" which is 65 kb in size created on May 30, 2018 and electronically submitted vis EFS-Web in the application is incorporated by reference in its entirety.

This invention relates to genetically modified cells that produce C6-C10 fatty acids and fatty acid derivatives such as C6-C10 fatty acid esters and C6-C10 fatty alcohols.

Fatty acids and fatty acid derivatives are useful as solvents for lacquers, paints, varnishes and other compositions; as plasticizers for organic resins, as fragrances and flavorings, as fuels for jet and other internal combustion engines, and as raw materials for making a variety of downstream products. Accordingly, the fatty acids and derivatives are currently produced industrially using non-renewable fossil fuels as the carbon source, or from oils derived from plants such as palm or coconut. Selectivity towards a specific chain length is an important shortcoming in these processes—the products tend to be a mixture of compounds having a range in number of carbon atoms. Separating the compounds into discrete chain lengths is difficult, and often much of the feedstock is converted to lower-value products that do not have the requisite number of carbon atoms.

Biological cells naturally produce fatty acid derivatives. For example, almost all living cells produce triglycerides of fatty acids as well as other fatty acid esters. The triglycerides and other esters play important roles in the metabolism, cellular structure, and other biological processes of the cells, and can perform other useful functions such as storing energy. Biological processes potentially offer a way to produce fatty acid derivatives industrially. Among other potential advantages, biologically-produced fatty acid and fatty acid derivative production in some cases can rely on annually renewable carbon sources such as sugars, rather than on fossil fuels.

The fatty acid groups produced in biological systems tend to have chain lengths of 12 carbon atoms or greater. Thus, naturally-occurring cells are a good source for C12 and higher fatty acids and derivatives. For example, triglycerides produced naturally by these cells can be hydrolyzed to produce C12 or higher fatty acids, which can in turn be converted to other derivatives such as esters or alcohols. On the other hand, few cells naturally produce fatty acids of C6-C10 chain length in significant quantities.

Shorter-chain fatty acids can be produced from biologically-produced oils and fat (and/or their constituent fatty acids), but doing so requires further capital costs for the necessary processing equipment and operating costs to effect the conversion to shorter chain lengths. In addition, the cost of feedstocks can vary considerably from year to year or from one geographical location to another due to weather effects on crop production.

Biological cells produce fatty acid derivatives through a native metabolic pathway that starts with acetyl-CoA and malonyl-ACP. Acetyl-CoA condenses with malonyl-ACP with loss of carbon dioxide and CoA to produce 3-ketobutyryl-ACP. Subsequent enzymatic reactions convert the 3-ketobutyryl-ACP successively to 3-hydroxybutyryl-ACP, then to trans-2-butenoyl-ACP (with loss of water) and finally to butyryl-ACP. The butyryl-ACP can re-enter this reaction cycle in place of acetyl-CoA to produce hexanoyl-ACP. This cycle repeats itself, producing in each iteration a longer carbon atom chain by adding two carbon atoms at a time, until terminated by some other cellular process. However, this native ACP-dependent pathway has low termination rates for C6-C10 chain lengths, resulting in low production of C6-C10 fatty acids and fatty acid derivatives.

Okamura et al., in PNAS vol. 107, no. 25, pp. 11265-11270 (2010) reported that the enzyme produced by the nphT7 gene of a soil-isolated *Streptomyces* strain catalyzes a single condensation of acetyl-CoA and malonyl-CoA to produce acetoacetyl-CoA.

As further described in US 2014/0051136, C4 fatty acid derivatives can be produced via a CoA-dependent pathway instead of the native ACP-dependent pathway by a cell modified to include the nphT7 gene and further non-native genes that encode a 3-ketoacyl-CoA reductase, a 3-hydroxyacyl-CoA dehydrase and a trans-2-enol-CoA reductase. However, the nphT7 gene is highly selective to the reaction of acetyl-CoA and malonyl-CoA to produce C4 fatty acids and derivatives. Unlike the native ACP-dependent pathway, the CoA-dependent pathway based on the nphT7 gene produces few fatty acid derivatives having C6 or greater chain length. Thus, as shown in US 2014/0051136, cells modified in this manner produce only small proportions of C6 or higher fatty acid derivatives.

WO 2015/10103 describes modifications to the NphT7 enzyme that permit it to more efficiently catalyze the condensation of longer-chain acyl-CoA compounds with malonyl-CoA. Certain strains were modified to include both the wild-type nphT7 gene and a variant of that gene. These cells produce greater relative quantities of longer fatty acids, but selectivity is poor. C6-C10 fatty acid derivatives in particular are made in only small amounts.

Therefore, there remains a desire for a process that produces fatty acids in good yields and with good selectivities to C6-C10 fatty acids or derivatives.

Applicants have discovered that C6-C10 fatty acids or derivatives may be produced by modifying a cell with mutant 3-ketoacyl-CoA synthase genes that produce in the cell certain mutant 3-ketoacyl-CoA synthase enzymes.

Naturally occurring 3-ketoacyl-CoA synthase enzymes that include at least one of sub-sequences SEQ ID NO. 87, SEQ ID NO. 105 or SEQ ID NO. 106, or a sub-sequence closely homologous to either of these, when heterologously expressed in a cell, tend to produce predominately C10 or higher fatty acids or derivatives, often with significant fractions of C12 or higher compounds. Applicants have found that by making specific mutations within these subsequences, the chain length of the fatty acids or derivatives is shifted downward, with C6-C10 chain lengths becoming predominant, and production of C12 and higher compounds becoming negligable. In particular cases, high selectivity toward C6 and/or C8 chain lengths is seen.

Therefore, this invention is in one aspect a 3-ketoacyl-CoA synthase having an amino acid sequence characterized by including at least one of a) a sub-sequence at least 80% identical to SEQ ID NO. 1, provided that amino acid residue 8 is leucine, valine, isoleucine or methionine and amino acid residue 2 is leucine or methionine or a sub-sequence at least 80% identical to SEQ ID NO. 160, provided that amino acid residue 8 is cysteine, leucine, valine, isoleucine or methionine and amino acid residue 2 is leucine, threonine or methionine; b) a sub-sequence at least 80% identical to SEQ ID NO. 2, provided that amino acid residue 6 is isoleucine or methionine and c) a sub-sequence at least 80% identical to SEQ ID NO. 3, provided that amino acid residue 6 is isoleucine, methionine, threonine, cysteine, valine, glutamine, phenylalanine, aspartic acid, asparagine or tyrosine. The invention in a further aspect is a genetically modified cell comprising a heterologous nucleic acid sequence encoding such a 3-ketoacyl-CoA synthase.

Applicants have further discovered that making specific mutations within certain heterologously expressing 3-ketoacyl-CoA synthases can increase production (e.g. increased titer) of fatty acids (and fatty acid derivatives) of C6 to C10 chain length. Thus in other aspects, the invention is a 3-ketoacyl-CoA synthase having an amino acid sequence characterized by including one or more of SEQ ID NO. 50, SEQ ID NO. 56, SEQ ID NO. 60, SEQ ID NO. 65, SEQ ID NO. 69 and SEQ ID NO. 170, and a genetically modified cell comprising a heterologous nucleic acid sequence encoding such a 3-ketoacyl-CoA synthase.

The invention is in particular aspects a mutant 3-ketoacyl-CoA synthase having SEQ ID NO. 119, and a genetically modified cell comprising a heterologous nucleic acid sequence encoding such a mutant 3-ketoacyl-CoA synthase. These mutant 3-ketaoacyl-CoA synthases have been found to improve production of compounds having straight-chain alkyl groups and specificity to C6-C10 chain lengths in such compounds. In particular embodiments, the mutant 3-ketoacyl-CoA synthase may have any of SEQ ID NO. 9, SEQ ID NO. 10, SEQ ID NO. 11, SEQ ID NO. 12, SEQ ID NO. 13, SEQ ID NO. 14, SEQ ID NO. 15, SEQ ID NO. 16, SEQ ID NO. 17, SEQ ID NO. 18, SEQ ID NO. 19, SEQ ID NO. 20, SEQ ID NO. 21, SEQ ID NO. 22, SEQ ID NO. 23, SEQ ID NO. 24, SEQ ID NO. 25, SEQ ID NO. 26, SEQ ID NO. 27, SEQ ID NO. 28, SEQ ID NO. 29, SEQ ID NO. 30, SEQ ID NO. 31, SEQ ID NO. 32, SEQ ID NO. 33, SEQ ID NO. 34, SEQ ID NO. 36, SEQ ID NO. 37, SEQ ID NO. 38, SEQ ID NO. 39, SEQ ID NO. 92, SEQ ID NO. 93, any one of SEQ ID NOs 121-157 or any one of SEQ ID NOs. 172-204.

The invention in other aspects includes methods of using the microoganisms of any of the foregoing aspects to make compounds having straight-chain alkyl groups. In particular aspects, the invention is a method for making one or more compounds having a straight-chain alkyl group, comprising culturing a genetically modified cell of the invention in a fermentation medium and recovering the compound(s) having a straight-chain alkyl group from the fermentation medium.

The following Table 1 contains a summary of 3-ketoacyl-CoA synthases sequences and sub-sequences referenced herein. In Table 1, "Asch" refers to *Acinetobacter schindleri* CIP 107287; "Asch-2" refers to *Acinetobacter schindleri* NIPH 900; "Ajoh-2" refers to *Acinetobacter* johnsii SH046; "Alwo" refers to *Acinetobacter lwoffii* SH145; "ANIPH71" refers to *Acinetobacter* sp NIPH 713; "Asch homologues" refers to Asch, Asch-2, Ajoh-2, Alwo and ANIPH71; "Pstu" refers to *Pseudomonas stutzeri* ATCC 17588 and "Aagr" refers to Alishewanella agri BL06.

TABLE 1

Summary of 3-ketoacyl-CoA synthase sequences and sub-sequences

| Seq ID No. | Mutant/ Wild Type | Full 3-ketoacyl-CoA sequence or sub-sequence | Aligns to: Organism | Amino Acid Nos. |
|---|---|---|---|---|
| 1 | Mutant | Sub-sequence | Asch homologues | 177-185 |
| 2 | Mutant | Sub-sequence | Pstu | 181-190 |
| 3 | Mutant | Sub-sequence | Aagr | 181-190 |
| 4 | Mutant | Sub-sequence | Asch homologues | 150-156 |
|   |   |   | Pstu | 151-157 |
|   |   |   | Aagr | 151-157 |
| 5 | Mutant | Sub-sequence | Asch, Asch-2, Ajoh-2 | 290-296 |
|   |   |   | ANIPH71, Alwo | 289-295 |
| 6 | Mutant | Sub-sequence | Asch, Asch-2, Ajoh-2 | 326-331 |
|   |   |   | ANIPH71, Alwo | 325-330 |
| 7 | Mutant | Sub-sequence | Asch homologues | 177-185 |
| 8 | Wild-Type | Full sequence | Asch | 1-370 |
| 9-21 | Mutant | Full sequence | Asch | 1-370 |
| 22-25 | Mutant | Sub-sequence | Asch-2 | 1-370 |
| 26-29 | Mutant | Full sequence | Alwo | 1-369 |
| 30 | Mutant | Full sequence | Ajoh-2 | 1-370 |
| 31-34 | Mutant | Full sequence | ANIPH71 | 1-369 |
| 35 | Wild-type | Full sequence | Ajoh-2 | 1-370 |
| 36 | Mutant | Full sequence | Asch | 1-370 |
| 37-39 | Mutant | Full sequence | Ajoh-2 | 1-370 |
| 40 | Mutant | Full sequence | Pstu | 1-373 |
| 41 | Mutant | Sub-sequence | Aagr | 181-190 |
| 42-43 | Mutant | Full sequence | Aagr | 1-372 |
| 44 | Mutant | Sub-sequence | Asch homologues | 150-185 |
| 45 | Mutant | Sub-sequence | Asch homologues | 150-238 |
| 46 | Mutant | Sub-sequence | Asch homologues | 290-338 |
| 47 | Mutant | Sub-sequence | Asch homologues | 150-338 |
| 48 | Mutant | Sub-sequence | Asch homologues | 1-149 |
| 49 | Mutant | Sub-sequence | Asch homologues | 1-338 |
| 50 | Mutant | Sub-sequence | Asch, Asch-2, Ajoh-2 | 275-281 |
|   |   |   | ANIPH71, Alwo | 274-280 |
| 51 | Mutant | Sub-sequence | Asch homologues | 177-185 |
| 52 | Mutant | Sub-sequence | Asch homologues | 150-185 |
| 53 | Mutant | Sub-sequence | Asch homologues | 150-238 |
| 54 | Mutant | Sub-sequence | Asch homologues | 150-338 |
| 55 | Mutant | Sub-sequence | Asch homologues | 1-338 |
| 56 | Mutant | Sub-sequence | Asch, Asch-2 | 291-300 |
| 57 | Mutant | Sub-sequence | Asch, Asch-2 | 290-338 |
| 58 | Mutant | Sub-sequence | Asch, Asch-2 | 150-338 |
| 59 | Mutant | Sub-sequence | Asch, Asch-2 | 1-338 |
| 60 | Mutant | Sub-sequence | Asch, Asch-2, Ajoh-2 | 177-190 |
| 61 | Mutant | Sub-sequence | Asch, Asch-2, Ajoh-2 | 150-190 |
| 62 | Mutant | Sub-sequence | Asch, Asch-2, Ajoh-2 | 150-238 |
| 63 | Mutant | Sub-sequence | Asch, Asch-2, Ajoh-2 | 150-338 |
| 64 | Mutant | Sub-sequence | Asch, Asch-2, Ajoh-2 | 1-338 |
| 65 | Mutant | Sub-sequence | Asch, Asch-2, Ajoh-2 | 316-331 |
|   |   |   | ANIPH71, Alwo | 315-330 |
| 66 | Mutant | Sub-sequence | Asch, Asch-2, Ajoh-2 | 290-338 |
|   |   |   | ANIPH71, Alwo | 289-337 |
| 67 | Mutant | Sub-sequence | Asch, Asch-2, Ajoh-2 | 150-338 |
|   |   |   | ANIPH71, Alwo | 150-337 |
| 68 | Mutant | Sub-sequence | Asch, Asch-2, Ajoh-2 | 1-338 |
|   |   |   | ANIPH71, Alwo | 1-337 |
| 69 | Mutant | Sub-sequence | Asch, Asch-2, Ajoh-2 | 266-274 |
|   |   |   | ANIPH71, Alwo | 265-273 |
| 70 | Mutant | Sub-sequence | Asch, Asch-2, Ajoh-2 | 150-338 |
|   |   |   | ANIPH71, Alwo | 150-337 |
| 71 | Mutant | Sub-sequence | Asch, Asch-2, Ajoh-2 | 1-338 |
|   |   |   | ANIPH71, Alwo | 1-337 |
| 72-81 | Mutant | Full sequence | Asch | 1-370 |
| 86 | Wild-type | Full sequence | Asch-2 | 1-370 |
| 87 | Mutant | Sub-sequence | Asch homologues | 177-185 |
| 88 | Wild-type | Full sequence | Alwo | 1-369 |
| 89 | Wild-type | Full sequence | ANIPH71 | 1-369 |
| 90 | Wild-type | Full sequence | Pstu | 1-373 |
| 91 | Wild-type | Full sequence | Aagr | 1-372 |

TABLE 1-continued

Summary of 3-ketoacyl-CoA synthase sequences and sub-sequences

| Seq ID No. | Mutant/ Wild Type | Full 3-ketoacyl-CoA sequence or sub-sequence | Aligns to: Organism | Amino Acid Nos. |
|---|---|---|---|---|
| 92-93 | Mutant | Full sequence | Asch | 1-370 |
| 97 | Mutant | Sub-sequence | Asch, Asch-2, Ajoh-2 | 316-331 |
|  |  |  | ANIPH71, Alwo | 315-330 |
| 105 | Mutant | Sub-sequence | Pstu | 181-190 |
| 106 | Mutant | Sub-sequence | Aagr | 181-190 |
| 107 | Mutant | Sub-sequence | Asch, Asch-2, Ajoh-2 | 266-274 |
|  |  |  | ANIPH71, Alwo | 265-273 |
| 108 | Mutant | Sub-sequence | Asch homologues | 275-281 |
| 109 | Mutant | Sub-sequence | Asch, Asch-2 | 291-300 |
| 110-111 | Mutant | Full Sequence | Asch homologues | 1-370 |
| 112 | Mutant | Full Sequence | Asch, Asch-2 | 1-370 |
| 113 | Mutant | Full Sequence | Asch, Asch-2, Ajoh-2 | 1-370 |
| 114-115 | Mutant | Full Sequence | Asch, Asch-2, Ajoh-2 | 1-370 |
|  |  |  | ANIPH71, Alwo | 1-369 |
| 116 | Mutant | Sub-sequence | Asch, Asch-2 | 177-190 |
| 119-159 | Mutant | Full Sequence | Asch homologues | 1-370 |
| 160 | Mutant | Sub-sequence | Asch homologues | 177-185 |
| 161 | Mutant | Sub-sequence | Asch homologues | 150-156 |
| 162 | Mutant | Sub-sequence | Asch, Asch-2, Ajoh-2 | 326-331 |
|  |  |  | ANIPH71, Alwo | 325-330 |
| 163 | Mutant | Sub-sequence | Asch homologues | 177-185 |
| 164 | Mutant | Sub-sequence | Asch homologues | 150-185 |
| 165 | Mutant | Sub-sequence | Asch homologues | 150-238 |
| 166 | Mutant | Sub-sequence | Asch homologues | 290-338 |
| 167 | Mutant | Sub-sequence | Asch homologues | 150-338 |
| 168 | Mutant | Sub-sequence | Asch homologues | 1-149 |
| 169 | Mutant | Sub-sequence | Asch homologues | 1-338 |
| 170 | Mutant | Sub-sequence | Asch homologues | 51-59 |
| 171 | Wild-type | Sub-sequence | Asch | 51-59 |
| 172-204 | Mutant | Full Sequence | Asch | 1-370 |

Amino acid residues in all amino acid sequences described herein are ordered in the N-terminus to C-terminus direction. "Upstream" means in the direction toward the N-terminus, and "downstream" means toward the C-terminus direction. The "start" of an amino acid sequence is the first amino acid residue in the N-terminus direction. The first amino acid residue (amino acid residue 1) for any sequence or sub-sequence described herein is the amino acid residue at its N-terminus.

A "sub-sequence" is a sequence of amino acid residues contained within a larger amino acid sequence.

"Identity" is used herein to indicate the extent to which two (nucleotide or amino acid) sequences have the same residues at the same positions in an alignment. The identity is expressed herein as a % identity as determined using BLAST (National Center for Biological Information (NCBI) Basic Local Alignment Search Tool) version 2.2.31 software, using default parameters unless indicated otherwise in this paragraph. Identity between amino acid sequences is determined using protein BLAST with the following parameters: Max target sequences: 100; Short queries: Automatically adjust parameters for short input sequences; Expect threshold: 10; Word size: 6; Max matches in a query range: 0; Matrix: BLOSUM62; Gap Costs: (Existence: 11, Extension: 1); Compositional adjustments: Conditional compositional score matrix adjustment; Filter: none selected; Mask: none selected. Nucleic acid % sequence identity between nucleic acid sequences is determined using standard nucleotide BLAST with the following default parameters: Max target sequences: 100; Short queries: Automatically adjust parameters for short input sequences; Expect threshold: 10; Word size: 28; Max matches in a query range: 0; Match/Mismatch Scores: 1, −2; Gap costs: Linear; Filter: Low complexity regions; Mask: Mask for lookup table only. A sequence having a % identity score of XX % (for example, 80%) to a reference sequence as determined in this manner is considered for purposes of this invention to be XX % identical to or, equivalently, have XX % sequence identity to, the reference sequence.

For purposes of this invention, an amino acid residue of a sequence or sub-sequence under investigation "aligns" to an amino acid residue of a reference sequence or sub-sequence when:

i) in the case of an entire sequence, the sequences are aligned using the BLAST version 2.2.31 software in the manner described above, and the amino acid residue of the sequence under investigation occupies the same position in the alignment as does the amino acid residue of the reference sequence;

ii) in the case of a sub-sequence, the sequence containing the sub-sequence under investigation is aligned with the reference sequence, and the amino acid residue of the sub-sequence under investigation occupies the same position in the alignment as does the amino acid residue of the reference sub-sequence.

For example, the 3-ketoacyl-CoA synthase enzyme of wild type *Acinetobacter schindleri* CIP 107287 (SEQ ID NO. 8) includes the following 9 amino acid residue sub-sequence.

| Amino Acid Residue | L | N | L | S | E | V | D | A | D |
|---|---|---|---|---|---|---|---|---|---|
| Position in Sub-Sequence | 1 | 2 | 3 | 4 | 5 | 6 | 7 | 8 | 9 |
| Position in Entire Sequence | 239 | 240 | 241 | 242 | 243 | 244 | 245 | 246 | 247 |

When the 3-ketoacyl-CoA synthase enzyme of wild type *Acinetobacter* sp NIPH 713 (SEQ. ID. NO. 89) is aligned with SEQ ID NO. 8 using the BLAST software as described, the following amino acid residues occupy the same positions in the alignment:

| *A. schindleri* sub-sequence | L | N | L | S | E | V | D | A | D |
|---|---|---|---|---|---|---|---|---|---|
| Position in *A. schindleri* sub-sequence | 1 | 2 | 3 | 4 | 5 | 6 | 7 | 8 | 9 |
| Position in entire *A. schindleri* sequence | 239 | 240 | 241 | 242 | 243 | 244 | 245 | 246 | 247 |
| *Acinetobacter* sp. NIPH 713 sub-sequence | L | N | T | S | E | — | N | A | D |

The leucine (L) of the *Acinetobacter* sp. NIPH sub-sequence aligns to the leucine at amino acid residue position 1 of the *A. schindleri* sub-sequence and also to the leucine at position 239 of the *A. schlindleri* 3-ketoacyl-CoA synthase sequence. A missing amino acid residue of the *Acinetobacter* sp. NIPH sub-sequence aligns to the valine (V) at amino acid residue position 6 of the *A. schindleri* sub-sequence and also to the valine of amine position 244 of the *A. schlindleri* 3-ketoacyl-CoA synthase sequence. The second asparagine (N) residue of the *Acinetobacter* sp. NIPH sub-sequence aligns to the aspartic acid residue at position 7 the of the *A. schindleri* sub-sequence and also to the aspartic acid residue at position 245 of the *A. schlindleri* 3-ketoacyl-CoA synthase sequence.

For purposes of this application, genetic material such as genes, promoters and terminators is "heterologous" if it is (i) non-native to the host cell and/or (ii) is native to the cell, but is present at a location different than where that genetic material is present in the wild-type host cell and/or (iii) is under the regulatory control of a non-native promoter and/or non-native terminator. Extra copies of native genetic material are considered as "heterologous" for purposes of this invention, even if such extra copies are present at the same locus as that genetic material is present in the wild-type host strain.

An enzyme (such as a 3-ketoacyl-CoA synthase) is "heterologous" if it is not produced by the wild-type host cell.

A "3-ketoacyl-CoA synthase" is an enzyme that catalyzes the condensation reaction of an acyl-CoA with malonyl-CoA to form a 3-ketoacyl-CoA. The ability of an enzyme to catalyze this reaction can be evaluated by measuring the release of free CoA-SH using 5,5'-dithiobis-(2-nitrobenzoic acid) (DTNB) reagent, malonyl-CoA as the donor substrate, and a C4-C8 acyl-CoA as the primer substrate, in the presence of the enzyme. The formation of the corresponding 3-ketoacyl-CoA from any of these primer substrates indicates the enzyme is a 3-ketoacyl-CoA synthase.

The ability of an enzyme to catalyze this reaction can also be evaluated using butyryl-CoA as the primer substrate and malonyl-CoA as the donor substrate in the presence of 5 mM $Mg^{++}$ salt by measuring the increase in absorbence at 303 nm as a function of the increase in the formation of the $Mg^{++}$-complex with the 3-ketohexanoyl-CoA product. 3-ketoacyl-CoA synthase will produce 3-ketohexanoyl-CoA from butyryl-CoA primer, 3-ketooctanoyl-CoA from haxanoyl-CoA primer, and 3-ketodecanoyl-CoA from octanoyl-CoA primer.

EC numbers are established by the Nomenclature Committee of the International Union of Biochemistry and Molecular Biology (NC-IUBMB) (*Enzyme Nomenclature* 1992 [Academic Press, San Diego, Calif., ISBN 0-12-227164-5 (hardback), 0-12-227165-3 (paperback)] with Supplement 1 (1993), Supplement 2 (1994), *Supplement* 3 (1995), *Supplement* 4 (1997) and *Supplement* 5 (in *Eur. J. Biochem.* 1994, 223, 1-5; *Eur. J. Biochem.* 1995, 232, 1-6; *Eur. J. Biochem.* 1996, 237, 1-5; *Eur. J. Biochem.* 1997, 250; 1-6, and *Eur. J. Biochem.* 1999, 264, 610-650). The EC numbers referenced herein are derived from the KEGG Ligand database, maintained by the Kyoto Encyclopedia of Genes and Genomics, sponsored in part by the University of Tokyo. Unless otherwise indicated, the EC numbers are as provided in the database as of April 2009.

A "fatty acid" for purposes of this invention is a straight-chain monoalkanoic acid having at least four carbon atoms.

A "derivative" of a fatty acid is a compound having a straight chain alkyl group formed in a series of one or more reactions at the site of the terminal carboxyl group of a fatty acid (or corresponding -CoA compound), to convert the terminal carboxyl group (without loss of the carboxyl carbon) to a different end group such as, for example, an ester, an alcohol group, an amino group, an aldehyde group, a ketone, a methyl group, or an alkenyl group. The length of the straight-chain alkyl group of the fatty acid is preserved in any such derivative, and may in some cases be extended.

A fatty acid ester is an ester compound corresponding to the reaction product of a fatty acid or a fatty acyl-CoA and an alcohol (with loss of water).

Chain lengths of fatty acids and derivatives are sometimes indicated herein by the shorthand "CX", wherein X is a number designating the number of carbon atoms. The number of carbon atoms designated in each case represents the carbon length of the straight-chain compound (after removal of CoA or ACP coenzymes) formed by the cell of the invention through one or more iterations of the reaction cycle:

acyl-CoA (or acyl-ACP)+malonyl-CoA to form a 3-ketoacyl compound;

reduction of the 3-ketoacyl compounds to form a 3-hydroxyacyl compound;

dehydration of the 3-hydroxyacyl-CoA to form a 3-enoylacyl compound; and reduction of the 3-enoylacyl compound to the corresponding acyl compound.

Each iteration of this reaction cycle adds two carbon atoms to the starting acyl-CoA or acyl-ACP. The number of carbon atoms does not include additional carbon atoms that may be added during the formation of any derivatives of the fatty acid, such as, for example, carbons included in an ester group. Thus, hexanoic acid methyl ester is considered as a "C6" fatty acid ester compound for purposes of this invention, the carbon of the methyl ester group not being counted.

In some embodiments, the genetically modified cell is a prokaryotic cell. In some embodiments, the genetically modified cell is a eukaryotic cell.

In some embodiments, the genetically modified cell is a microorganism, and may be a single-celled microorganism.

The host cell may be a plant cell, including a cell from a plant within any of the *Chlorophyta, Charophyta, Marchantiophyta, Anthocerotophyta, Bryophyta, Lycopodiophyta, Pteridophyta, Cycadophyta, Ginkgophyta, Pinophyta, Gnetophyta or Magnoliophyta* plants. Such a plant cell may be, for example, a cell from a plant within any of the genera *Arabidopsis, Beta, Glycine, Jatropha, Miscanthus, Panicum, Phalaris, Populus, Saccharum, Salix, Simmondsia,* and *Zea.*

The host cell may be a fungi, microalgae, algae or red algae (heterokont) cell. The host cell may be a yeast cell. A yeast or fungus cell may be an oleaginous yeast or fungus, and/or may be a Crabtree negative yeast or fungus.

The term "oleaginous fungi" refers to yeasts or filamentous fungi, which accumulate at least 10%, 12.5%, 15%, 17.5%, preferably at least 20% or even at least 25% (w/w) of their biomass as lipid. They may even accumulate at least 30%, 40%, 50%, 60%, 70%, 80% (w/w) or more of their biomass as lipids. The biomass is usually measured as cell dry weight (CDW).

A "Crabtree-positive" organism is one that is capable of producing ethanol in the presence of oxygen, whereas a "Crabtree-negative" organism is not. A yeast cell having a Crabtree-negative phenotype is any yeast cell that does not exhibit the Crabtree effect. The term "Crabtree-negative" refers to both naturally occurring and genetically modified organisms. Briefly, the Crabtree effect is defined as the inhibition of oxygen consumption by a microorganism when cultured under aerobic conditions due to the presence of a high concentration of glucose (e.g., 10 g-glucose L-1). In other words, a yeast cell having a Crabtree-positive phenotype continues to ferment irrespective of oxygen availability due to the presence of glucose, while a yeast cell having a Crabtree-negative phenotype does not exhibit glucose mediated inhibition of oxygen consumption. Crabtree-positive yeast produce an excess of alcohol rather than biomass production.

Examples of suitable yeast cells include, *Pichia, Candida, Klebsiella, Hansenula, Kluyveromyces, Trichosporon, Brettanomyces, Pachysolen, Issatchenkia, Yamadazyma Saccharomyces, Schizosaccharomyces, Zygosaccharomyces, Debaryomyces, Cryptoococcus, Rhodotorula, Rhodosporidium, Lipomyces* and *Yarrowia.* Examples of specific host yeast cells include *C. sonorensis, K. marxianus, K. thermotolerans, C. methanesorbosa, Saccharomyces bulderi (S. bulderi), I. orientalis, C. lambica, C. sorboxylosa, C. zem-*

*plinina, C. geochares, P. membranifaciens, Z. kombuchaensis, C. sorbosivorans, C. vanderwaltii, C. sorbophila, Z. bisporus, Z. lentus, Saccharomyces bayanus (S. bayanus), D. castellii, C. boidinii, C. etchellsii, K. lactis, P. jadinii, P. anomala, Saccharomyces cerevisiae (S. cerevisiae) Pichia galeiformis, Pichia* sp. YB-4149 (NRRL designation), *Candida ethanolica, P. deserticola, P. membranifaciens, P. fermentans, Rhodosporidium toruloide, Lipomyces starkeyii, L. lipoferus, Candida revkaufi, C. pulcherrima, C. tropicalis, C. utilis, Trichosporon pullas, T. cutaneum, Rhodotorula glutinous, R. garminis, Yarrowia lipolytica* and *Saccharomycopsis crataegensis (S. crataegensis)*. Suitable strains of *K. marxianus* and *C. sonorensis* include those described in WO 00/71738 A1, WO 02/42471 A2, WO 03/049525 A2, WO 03/102152 A2 and WO 03/102201A2. Suitable strains of *I. orientalis* are ATCC strain 32196 and ATCC strain PTA-6648.

In some embodiments, the host cell is a bacteria cell. The bacteria may be a gram-positive or gram-negative bacteria. It may be a cell within any of the Chlamydiae, green nonsulfur, actinobacteria, planctomycetes, spirochaetes, fusobacteria, cyanobacteria, thermophilic sulphate-reducer, acidobacteria or proteobacteria classifications of bacteria (Ciccarelli et al., *Science* 311 (5765): 1283-7 (2006).

Examples of suitable bacteria cells include, for example, those within any of the genera *Clostridium, Zymomonas, Escherichia, Salmonella, Rhodococcus, Pseudomonas, Streptomyces, Bacillus, Lactobacillus, Enterococcus, Alcaligenes, Klebsiella, Paenibacillus, Arthrobacter, Corynebacterium, Bacteriophage, Brevibacterium, Acanthoceras, Acanthococcus, Acarvochloris, Achnanthes, Achnanthidiun, Actinastrum, Actinochloris, Actinocyclus, Actinotaenium, Amphichrsis, Amphidiniunm, Amphikrikos, Amplhipleura, Amphiprora, Amphithrix, Amphora, Anabaena, Anabaenopsis, Aneumnastus, Ankistrodesmius, Ankyra, Anomoeoneis, Apatococcus, Aphanizomenon, Aphanocapsa, Aphanochaete, Aphanothece, Apiocystis, Apistonema, Arthrodesmus, Artherospira, Ascochloris, Asterionella, Asterococcus, Audouinella, Aularoseira, Bacillaria, Balbiania, Bambiusina, Bangia, Basichlamys, Batrarhospermum, Binurlearia, Bitrichia, Blidingia, Botrdiopsis, Botrydium, Botryococcus, Botryosphaerella, Brachiomonas, Brachysira, Brachytrichia, Brebissonia, Bulbochaete, Bumnilleria, Buinilleriopsis, Caloneis, Calothrix, Campylodiscus, Capsosiphon, Carteria, Catena, Cavinula, Cenritractus, Centroniella, Ceratiunt, Chaetoceros, Chaetochloris, Chaetomorpha, Chaetonella, Chaetonemna, Chaetopeltis, Chaetophora, Chaetosphaeridium, Chamaesiphon, Chara, Characiochloris, Characiopsis, Characium, Charales, Chilomonas, Chlainomonas, Chlamydoblepharis, Chlamydocapsa, Chlamydomonas, Chlamydomonopsis, Chlamydomnyxa, Chlamydonephris, Chlorangiella, Chlorangiopsis, Chlorella, Chlorobotrys, Chlorobrachis, Chlorochytrium, Chloroccun, Chlorogloea, Chlorogloeopsis, Chlorogonium, Chlorolobion, Chloromonas, Chlorophysema, Cholorphyta, Cholorosaccus, Cholorosarcina, Choricystis, Chromophyton, Chromulina, Chroococcidiopsis, Chrococcus, Chroodactylon, Chroomonas, Chroothece, Chrysamoeba, Chysapsis, Chrysidiastrum, Chrysocapsa, Chrysocapsella, Chrysochaete, Chrysohromulina, Chrysococcus, Chrysocrinus, Chrynsolepidomonas, Chrysolykos, Chrysonebula, Chrysophyta, Chrysopyxis, Chrysosaccus, Chrysophaerella, Chrysotephanosphaera, Clodophora, Clastidium, Closteriopsis, Closterium, Coccomyxa, Cocconeis, Coelastrella, Coelastrum, Coelosphaerium, Coenochloris, Coenococcus, Coenocystis, Colacium, Coleochaete, Collodictyon, Compsogonopsis, Compsopogon, Conjugatophyta, Conoehaete, Coronastrum, Cosmarium, Cosmnioneis, Cosmocladium, Crateriportula, Craticula, Crinalium, Crucigenia, Crucigeniella, Cryptoaulax, Cryptomonas, Cryptophyta, Ctenophora, Cyanodictyon, Cyanonephron, Cyanophora, Cyanophyta, Cyanothece, Cyanothomonas, Cyclonexis, Cyclostephanos, Cyclotella, Cylindrocapsa, Cylindrocystis, Cylindrospermum, Cylindrotheca, Cymatopleura, Cymbella, Cymbeilonitzschia, Cystodinium Dactylococcopsis, Debarya, Denticula, Dermatochrysis, Dermorarpa, Dermocarpella, Desmatractum, Desmidium, Desmococcus, Desmonema, Desmosiphon, Diacanthos, Diacronema, Diadesmis, Diatoma, Diatomella, Dicellula, Dichothrix, Dichtotomococcrus, Dicranochaete, Dictyochloris, Dictyococcus, Dictyosphaerium, Didymocystis, Didymogenes, Didymosphenia, Dilabifilum, Dimorphoccus, Dinobryon, Dinocuccus, Diplochloris, Diploneis, Diplostauron, Distrionella, Docidium, Draparnaldia, Dunaliella, Dysmorphaocuccus, Ecballocystis, Elakatothrix, Ellerbeckia, Encyonema, Enteromorpha, Entocladia, Entomoeis, Entophysalis, Ephichrysis, Epipyxis, Epithemia, Eremosphaura, Euastropsis, Euatstrum, Eucapsis, Eucocconeis, Eudorina, Euglena, Euglenophyta, Eunotia, Eustigmatophyta, Eutreptia, Fallcia, Ficherella, Fragilaria, Fragilariforma, Franceia, Frustulia, Curcilla, Geminella, Genicularia, Glaucocystis, Glaucophyta, Glenodiniopsis, Glenodinium, Gloeomonas, Gloeoplax, Gloeothece, Geloeotila, Gloeotrichia, Gloiodictyon, Golenkinia, Golenkiniopsis, Gomontia, Gomphocymbella, Gomphonema, Gomphosphaeria, Gonatozygon, Gongrosia, Gongrosira, Goniochloris, Gonium, Gonyostomum, Granulochloris, Granulocystopsis, Groenbladia, Gymnodiunium, Gymnozyga, Gyrosignma, Haematocuccus, Hafniomonas, Hallassia, Hammatoidea, Hannaea, Hantzchia, Hapalosiphon, Haplotaenium, Haptophyta, Haslea, Hemidinuim, Hemitonia, Heribaudiella, Heteromastix, Heterothrix, Hibberdia, Hildenbrandia, Hillea, Holopedium, Homoeothrix, Hormanthonema, Hormotila, Hyalobrachion, Hyalocardium, Hyalodiscus, Hyalogonium, Hyalotheca, Hydrianum, Hydrococcus, Hydrocoleum, Hydrocoryne, Hydrodictyon, Hydrosera, Hydrurus, Hyella, Hymenomonas, Isthmochloron, Johannesbaptistia, Juranyiella, Karayevia, Kathablepharis, Katodinium, Kaphyrion, Keratococcus, Kirchneriella, Klebsormidium, Kolbesia, Koliella, Komarekia, Korshikoviella, Kraskella, Lagerheimia, Lagynion, Lamprothamnum, Lemanea, Lepocinclis, Leptosira, Lobococcus, Lobocystis, Lobomonas, Luticola, Lynbya, Malleochloris, Mallomonas, Mantoniella, Marssoniella, Martyana, Mastigocloleus, Gastogloia, Melosira, Merismopedia, Mesostigma, Mesotaenium, Micractinium, Micrasterias, Microchaete, Microcoleus, Microcystis, Microglena, Micromonas, Microspora, Microthamnion, Mischococcus, Monocrysis, Monodus, Monomastix, Monoraphidium, Monostroma, Mougeotia, Mougeotiopsis, Myochloris, Myromecia, Myxocarcina, Naegeliella, Nannochloris, Nautoccus, Navicula, Neglectella, Neidium, Nephroclamys, Nephrocytium, Nephrodiella, Nephroselmis, Netrium, Nitella, Nitellopsis, Nitzschia, Nodularia, Nostoc, Ochromonas, Oedogonium, Oligochaetophora, Onychonema, Oocadrium, Oocrystis, Opephora, Ophiocytium, Orthoseira, Oscillartoria, Oxyneis, Pachycladella, Palmella, Palmodictyon, Pnadorina, Pannus, Paralia, Pascherina, Paulshulzia, Pediastrum, Pedinella, Pedinomonas, Pedinopera, Pelagodictyon, Penium, Peranema, Peridiniopsis, Peridinium, Peronia, Petroneis, Phacotus, Phacus, Phaeaster, Phaeodermatium, Phaeophyta, Phaeoshaera, Phaeothamnion, Phormidium, Phycopeltis, Phyllariochloris, Phyllocadium, Phyllomitas, Pinnilaria, Pitophora, Placoneis, Planctonema, Planktophaeria, Planothidium, Plec-* tonema, Pleodorina, Pleurastrum, Pleurocapsa, Pleurocladia, Pleurodiscus, Pleurosigma, Pleurosira, Pleurotaenium, Pocillomanas, Podohedea, Polyblepharides, Polychaetophora, Polyedriella, Polyedriopsis, Polygoniochloris, Polyepidomanas, Polytaenia, Polytoma, Polytomella, Porphyridium, Posteriochromonas, Prasinochloris, Prasinocladus, Prasinophyta, Praisola, Prochlorphyta, Psammodictyon, Psammothidium, Pseudanabaena, Pseudenoclonium, Psuedocarteria, Pseudochate, Pseaudocharacium, Pseudococcomyxa, Pseudodictyosphaerium, Pseudokephyrion, Pseudoncobrysa, Pseudoquadrigula, Pseudophaerocystis, Pseudostaurastrum, Pseudostaurosira, Pyrrophyta, Quadrichloris, Quadricoccus, Quadrigula, Radiocuccus, Radiobetalum, Raphidiopsis, Raphidocelis, Raphidonema, Raphidophyta, Peimeria, Rhadorderma, Rhabomonas, Rhizoclonium, Rhodomonas, Rhodiphyta, Rhoicosenia, Rhopalodia, Rivularia, Rosenvingiella, Rossithidium, Roya, Scenedesmus, Scherffelia, Schizochlamydella, Schizochlamys, Schizomeris, Schizothrix, Schroederia, Scolioneis, Scotiella, Scotiellopsis, Scourfieldia, Scytonema, Slenastrum, Selenochloris, Sellaphora, Semiorbis, Siderocelis, Diderocys tops is, Dimonsenia, Siphononema, Sirocladium, Sirogonium, Skeletonema, Sorastrum, Spermatozopis, Sphaerellocystis, Sphaerellopsis, Sphaerodinium, Sphaeroplea, Sphaerozosma, Spiniferomonas, Spirogyra, Spirotaenia, Spirulina, Spondylomorum, Spondylosium, Sporotetras, Spumella, Staurastrum, Stauerodesmus, Stauroneis, Staurosira, Staurrosiella, Stenopterobia, Stephanocostis, Stephanodiscus, Stephanoporos, Stephanoshaera, Stichoccus, Stichogloea, Sigeoclonium, Stigonema, Stipitocuccus, Stokesiella, Stombomonas, Stylochrysalis, Stylodinium, Styloyxis, Stylosphaeridium, Surirella, Sykidion, Symploca, Synechococcus, Synechocystis, Synedra, Synochromonas, Synura, Tabellaria, Tabularia, Teilingia, Temnogametum, Tetmemorus, Tetrachlorella, Tetracyclus, Tetrademus, Tetraedriella, tetraedron, Tetraselmis, Tetraspora, Tetrastrum, Thalassiosira, Thanmiochaete, Thoakochloris, Thorea, Tolypella, Tolypothrix, Trachelomonas, Trachydiscus, Trebouxia, Trentepholia, Treubaria, Tribonema, Trichodesmium, Tricodiscus, Trochiscia, Tryblionella, Ulothrix, Uroglena, Uronema, Urosolenia, Urospora, Uva, Vacuolaria, Vaucheria, Volvox, Volvulina, Westella, Woloszynskia, Xanthidium, Xanthophyta, Exencoccus, Zygenema, Zygnemopsis, and Zygonium.

Specific examples of bacteria host cells include *Escherichia coli; Oligotropha carboxidovorans, Pseudomonas* sp. *Alcaligenes eutrophus (Cupriavidus necator), Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis, Cupriavidus basilensis, Cupriavidus campinensis, Cupriavidus gilardi, Cupriavidus laharsis, Cupriavidus metallidurans, Cupriavidus oxalaticus, Cupriavidus pauculus, Cupriavidus pinatubonensis, Cupriavidus respiraculi, Cupriavidus taiwanensis, Mycobacterium smegmatis, Mycobacterium abscessus, Mycobacterium avium, Mycobacterium bovis, Mycobacterium tuberculosis, Mycobacterium leprae, Mycobacterium marinum,* and *Mycobacterium ulcerans*. In other embodiments, the bacterium is *Nocardia* sp. NRRL 5646, *Nocardia farcinica, Streptomyces griseus, Salinispora arenicola,* or *Clavibacter michiganenesis*.

The host cell may be a synthetic cell or a cell produced by a synthetic genome, as described in U.S. Patent Publication 2007/0264688, or 2007/0269862. The host cell may be a CHO cell, a COS cell, a VERO cell, a BHK cell, a HeLa cell, a Cv1 cell, an MDCK cell, a 293 cell, a 3T3 cell, or a PC12 cell.

In certain embodiments, the 3-ketoacyl-CoA synthase includes sub-sequence SEQ ID NO. 1 or SEQ ID NO. 160, or a sub-sequence at least 80% identical to SEQ ID NO. 1 or SEQ ID NO. 160, provided that that an amino acid residue that aligns to amino acid residue 8 in each case is any one of leucine, valine, isoleucine or methionine and an amino acid residue that aligns to amino acid residue 8 is leucine or methionine in the case of SEQ ID NO. 1 and leucine, methionine or threonine in the case of SEQ ID NO. 160. SEQ ID NO. 1 differs from SEQ ID NO. 87 in that the threonine in amino acid residue position 8 of SEQ ID NO. 87 is replaced in SEQ ID NO. 1 with any one of leucine, valine, isoleucine or methionine. SEQ ID NO. 160 differs from SEQ ID NO. 87 in that the threonine in amino acid residue position 8 of SEQ ID NO. 87 is replaced in SEQ ID NO. 160 with any one of leucine, valine, isoleucine or methionine, and amino acid residue in position 2 may also be threonine. SEQ ID NO. 87 represents a sub-sequence found in a range of naturally-occurring 3-ketoacyl-CoA synthases. SEQ ID NO. 87 appears, for example in the naturally-occurring 3-ketoacyl-CoA synthases of *Acinetobacter schindleri* CIP 107287 (as amino acid residues 177-185 of SEQ ID NO. 8, amino acid residue 178 being methionine); *Acinetobacter schindleri* NIPH 900 (as amino acid residues 177-185 of SEQ ID NO. 86, amino acid residue 178 being methioine); *Acinetobacter johnsii* SH046 (as amino acid residues 177-185 of SEQ ID NO. 35, amino acid residue 178 being leucine); *Acinetobacter lwoffii* SH145 (as amino acid residues 177-185 of SEQ ID NO. 88, amino acid residue 178 being leucine); *Acinetobacter* sp NIPH 713 (as amino acid residues 177-185 of SEQ ID NO. 89, amino acid residue 178 being leucine). This substitution of the threonine indicated at amino acid residue 8 of sub-sequence SEQ ID NO. 1 or SEQ ID NO. 160 has been found to shift fatty acid production (and production of fatty acid derivatives) toward C6, C8 and/or C10 fatty acids and derivatives.

The 3-ketoacyl-CoA synthase in some embodiments includes at least one sub-sequence selected from a) SEQ ID NO. 4 or SEQ ID NO. 161, b) SEQ ID NO. 5 and c) SEQ ID NO. 6 or SEQ ID NO. 162. The 3-ketoacyl-CoA synthase preferably includes each of a), b) and c).

In some embodiments in which SEQ ID NO. 4 or SEQ ID NO. 161 is present in the 3-ketoacyl-CoA synthase, sub-sequence SEQ ID NO. 4 is present upstream of subsequence SEQ ID NO. 1 or SEQ ID NO. 160, as the case may be. The start of sub-sequence SEQ ID NO. 4 or SEQ ID NO. 161, as the case may be, may be located, for example, 25 to 30 amino acid residues, especially exactly 27 amino acid residues, upstream of the start of sub-sequence SEQ ID NO. 1 or SEQ ID NO. 160 (as the case may be) in such 3-ketoacyl-CoA synthase enzymes.

The 3-ketoacyl-CoA synthase in some embodiments includes sub-sequence SEQ ID NO. 44 and/or SEQ ID No. 45, or a sub-sequence at least 85% identical to either of those. As can be seen by comparing the sequences, each of SEQ ID NOs. 44 and 45 includes SEQ ID NO. 4 (which appears as amino acid residues 1-7 of SEQ ID NOs. 44 and 45) and SEQ ID NO. 1 (which appears as amino acid residues 28-36 of SEQ ID NOs. 44 and 45). In sub-sequence SEQ ID NOs. 44 and 45, the start of sub-sequence SEQ ID NO. 4 is positioned 27 amino acid residues upstream of the start of sub-sequence SEQ ID NO. 1.

The 3-ketoacyl-CoA synthase in some embodiments includes sub-sequence SEQ ID NO. 164 and/or SEQ ID No.

165, or a sub-sequence at least 85% identical to either of those. As can be seen by comparing the sequences, each of SEQ ID NOs. 164 and 165 includes SEQ ID NO. 161 (which appears as amino acid residues 1-7 of SEQ ID NOs. 164 and 165) and SEQ ID NO. 160 (which appears as amino acid residues 28-36 of SEQ ID NOs. 164 and 165). In sub-sequence SEQ ID NOs. 164 and 165, the start of sub-sequence SEQ ID NO. 161 is positioned 27 amino acid residues upstream of the start of sub-sequence SEQ ID NO. 160.

In some embodiments in which SEQ ID NO. 5 is present in the 3-ketoacyl-CoA synthase, sub-sequence SEQ ID NO. 5 is preferably present downstream of sub-sequence SEQ ID NO. 1 or SEQ ID NO. 160, as the case may be. The start of sub-sequence SEQ ID NO. 5 may be located, for example, 100 to 120 amino acid residues, 108 to 116 amino acid residues, or exactly 112 or 113 amino acids, downstream of the start of sub-sequence SEQ ID NO. 1 or SEQ ID NO. 160 (as the case may be) in such 3-ketoacyl-CoA synthase enzymes.

In some embodiments in which SEQ ID NO. 6 or SEQ ID NO. 162 is present in the 3-ketoacyl-CoA synthase, sub-sequence SEQ ID NO. 6 or SEQ ID NO. 162, as the case may be, preferably is present downstream of sub-sequence SEQ ID NO. 1 or SEQ ID NO. 160, as the case may be. The start of sub-sequence SEQ ID NO. 6 or SEQ ID NO. 162 may be located, for example, from 140 to 160 amino acid residues, from 145 to 155 amino, especially exactly 147 or 148 amino acid residues, downstream of the start of sub-sequence SEQ ID NO. 1 or SEQ ID NO. 160 (as the case may be) in such 3-ketoacyl-CoA synthase enzymes.

In some embodiments in which both sub-sequences SEQ ID NOs. 5 and 6 are present, the 3-ketoacyl-CoA synthase includes sub-sequence SEQ ID NO. 46. In SEQ ID NO. 46, sub-sequence SEQ ID NO. 5 appears as amino acid residues 1-7 and sub-sequence SEQ ID NO. 6 appears as amino acid residues 36-42.

In some embodiments in which both sub-sequences SEQ ID NOs. 5 and 162 are present, the 3-ketoacyl-CoA synthase includes sub-sequence SEQ ID NO. 166. In SEQ ID NO. 166, sub-sequence SEQ ID NO. 5 appears as amino acid residues 1-7 and sub-sequence SEQ ID NO. 162 appears as amino acid residues 36-42.

In some embodiments in which each of sub-sequences SEQ ID NOs. 4, 5 and 6 are present, the 3-ketoacyl-CoA synthase includes sub-sequence SEQ ID NO. 47. In SEQ ID NO. 47, sub-sequence SEQ ID NO. 4 appears as amino acid residues 1-7: sub-sequence SEQ ID NO. 1 appears as amino acid residues 28-36; sub-sequence SEQ ID NO. 5 appears as amino acid residues 141-147 and sub-sequence SEQ ID NO. 6 appears as amino acid residues 176-182.

In some embodiments in which each of sub-sequences SEQ ID NOs. 161, 5 and 162 are present, the 3-ketoacyl-CoA synthase includes sub-sequence SEQ ID NO. 167. In SEQ ID NO. 167, sub-sequence SEQ ID NO. 161 appears as amino acid residues 1-7: sub-sequence SEQ ID NO. 160 appears as amino acid residues 28-36; sub-sequence SEQ ID NO. 5 appears as amino acid residues 141-147 and sub-sequence SEQ ID NO. 162 appears as amino acid residues 176-182.

In any of the foregoing embodiments, the 3-ketoacyl-CoA synthase may include sub-sequence SEQ ID NO. 48 or SEQ ID NO. 168. SEQ ID NO. 48 or SEQ ID NO. 168 preferably is upstream of sub-sequence SEQ ID NO. 1 or SEQ ID NO. 160, as the case may be and upstream of each of sub-sequences SEQ ID NOs, 4 or 161, 5 and 6 or 162, when present.

In some embodiments, the 3-ketoacyl-CoA synthase includes SEQ ID. NO 49 or a sequence that is at least 80%, at least 90% or at least 95% identical to SEQ ID NO. 49, provided that an amino acid residue that aligns to position 184 of SEQ ID NO. 49 is one of leucine, valine, isoleucine or methionine.

In some embodiments, the 3-ketoacyl-CoA synthase includes SEQ ID NO. 169 or a sequence that is at least 80%, at least 90% or at least 95% identical to SEQ ID NO. 169, provided that an amino acid residue that aligns to position 184 of SEQ ID NO. 169 is one of cysteine, leucine, valine, isoleucine or methionine.

In some embodiments, the 3-ketoacyl-CoA synthase has SEQ ID. NO 110 or is at least 80%, at least 90% or at least 95% identical to SEQ ID NO. 110, provided that an amino acid residue of the 3-ketoacyl-CoA that aligns to amino acid residue 184 of SEQ ID NO. 110 is one of leucine, valine, isoleucine or methionine.

In some embodiments, the 3-ketoacyl-CoA synthase has SEQ ID NO. 119 or a sequence that is at least 80%, at least 90% or at least 95% identical to SEQ ID NO. 119, provided that an amino acid residue that aligns to position 184 of SEQ ID NO. 119 is one of cysteine, leucine, valine, isoleucine or methionine.

In other embodiments, the 3-ketoacyl-CoA synthase is at least 50%, at least 75%, at least 80%, at least 90% or at least 95% identical to any of SEQ ID NOs. 8, 35, 86, 88 or 89, provided in each case that an amino acid residue of the 3-ketoacyl-CoA synthase that aligns to amino acid residue 184 of any of SEQ ID NOs. 8, 35, 86, 88 or 89 is leucine, valine, isoleucine or methionine.

In specific embodiments, the 3-ketoacyl-CoA synthase has any of SEQ ID NOs. 9-34, 36-39, 92-93, 121-157 or 172-204, or is at least 50%, at least 75%, at least 80%, at least 90% or at least 95% identical to any of SEQ ID NOs. 9-34, 36-39, 92-93, 121-157 or 172-204, provided in each case that an amino acid residue of the 3-ketoacyl-CoA that aligns to amino acid residue 184 of any of SEQ ID NOs. 9-34, 36-39, 92-93, 121-157 or 172-204 is one of leucine, valine, isoleucine or methionine.

In certain embodiments, the 3-ketoacyl-CoA synthase includes sub-sequence SEQ ID NO. 2, or a sequence at least 80% identical to SEQ ID NO. 2, provided that an amino acid residue of the 3-ketoacyl-CoA that aligns to amino acid residue 6 of SEQ ID NO. 2 is isoleucine or methionine. A sub-sequence otherwise identical to SEQ ID NO. 2, but in which the amino acid residue aligning to amino acid residue 6 of SEQ ID NO. 2 is cysteine, appears in naturally-occurring 3-ketoacyl-CoA synthases such as that of *Pseudomonas stutzeri* ATCC 17588 (SEQ ID NO. 90, where such a sequence appears as amino acid residues 181-190 (with the cysteine appearing as amino acid residue 186). This substitution of the cysteine has been found to shift fatty acid production (and production of fatty acid derivatives) toward C6, C8 and/or C10 fatty acids and derivatives, and away from longer-chain compounds.

As before, a 3-ketoacyl-CoA synthase that includes sub-sequence SEQ ID NO. 2 may include at least one sub-sequence selected from a) SEQ ID NO. 4 or SEQ ID NO. 161, b) SEQ ID NO. 5 and c) SEQ ID NO. 6 or SEQ ID NO. 162. The 3-ketoacyl-CoA synthase preferably includes each of these sub-sequences. When sub-sequence SEQ ID NO. 4 or SEQ ID NO. 161 is present, sub-sequence SEQ ID NO. 4 or SEQ ID NO. 161 is present upstream of subsequence SEQ ID NO. 2, and its start may be located, for example, 25 to 35 amino acid residues, 28 to 32 amino acid residues, or especially exactly 30 amino acid residues, upstream of the start of sub-sequence SEQ ID NO. 2. When sub-sequence SEQ ID NO. 5 is present, sub-sequence SEQ ID NO. 5 preferably is present downstream of sub-sequence SEQ ID NO. 2, and the start of sub-sequence SEQ ID NO. 5 may be located, for example, 100 to 120 amino acid residues, from 110 to 118, especially exactly 115 or 116 amino acid residues, downstream of the start of sub-sequence SEQ ID NO. 2. When sub-sequence SEQ ID NO. 6 or SEQ ID NO. 162 is present, sub-sequence SEQ ID NO. 6 or SEQ ID NO. 162 preferably is present downstream of sub-sequence SEQ ID NO. 2, and the start of sub-sequence SEQ ID NO. 6 or SEQ ID NO. 162 may be located, for example, from 140 to 160 amino acid residues, from 145 to 155 amino acid residue, especially exactly 148, 149 or 150 amino acid residues, downstream of the start of sub-sequence SEQ ID NO. 2 in such 3-ketoacyl-CoA synthase enzymes.

In some embodiments in which sub-sequence SEQ ID NO. 2 is present, the 3-ketoacyl-CoA synthase is at least 50%, at least 75%, at least 80%, at least 90% or at least 95% identical to SEQ ID NO. 40, provided that an amino acid residue of the 3-ketoacyl-CoA synthase that aligns to amino acid residue 186 of SEQ ID NO. 40 is isoleucine or methionine.

In certain embodiments, the 3-ketoacyl-CoA synthase includes sub-sequence SEQ ID NO. 3, or a sequence at least 80% identical to SEQ ID NO. 3, provided that an amino acid residue of the 3-ketoacyl-CoA that aligns to amino acid residue 6 of SEQ ID NO. 3 is any one of isoleucine, methionine, leucine, threonine, cysteine, valine, glutamine, phenylalanine, aspartic acid, asparagine and tyrosine. A sub-sequence otherwise identical to SEQ ID NO. 3, but in which the amino acid residue that aligns to amino acid residue 6 of SEQ ID NO. 3 is alanine, appears in naturally-occurring 3-ketoacyl-CoA synthases such as that of Alishewanella agri BL06 (SEQ ID NO. 91, where such a sequence appears as amino acid residues 181-190 (with the alanine appearing as amino acid residue 186). This substitution of the alanine has been found to sharply reduce the production of C12 fatty acids and derivatives in favor of C6, C8 and/or C10 fatty acids and derivatives.

As before, a 3-ketoacyl-CoA synthase that includes sub-sequence SEQ ID NO. 3 may include at least one sub-sequence selected from a) SEQ ID NO. 4 or SEQ ID NO. 161, b) SEQ ID NO. 5 and c) SEQ ID NO. 6 or SEQ ID NO. 162. The 3-ketoacyl-CoA synthase preferably includes each of these sub-sequences. When sub-sequence SEQ ID NO. 4 or SEQ ID NO 161 is present, sub-sequence SEQ ID NO. 4 or SEQ ID NO. 161 is present upstream of subsequence SEQ ID NO. 3, and its start may be located, for example, 25 to 35 amino acid residues, 28 to 32 amino acid residues, or especially exactly 30 amino acid residues, upstream of the start of sub-sequence SEQ ID NO. 3. When sub-sequence SEQ ID NO. 5 is present, sub-sequence SEQ ID NO. 5 preferably is present downstream of sub-sequence SEQ ID NO. 3, and the start of sub-sequence SEQ ID NO. 5 may be located, for example, 100 to 120 amino acid residues, from 110 to 118, especially exactly 115 or 116 amino acid residues, downstream of the start of sub-sequence SEQ ID NO. 3. When sub-sequence SEQ ID NO. 6 or SEQ ID NO. 162 is present, sub-sequence SEQ ID NO. 6 or SEQ ID NO. 162 preferably is present downstream of sub-sequence SEQ ID NO. 3, and the start of sub-sequence SEQ ID NO. 6 or SEQ ID NO. 162 may be located, for example, from 140 to 160 amino acid residues, from 145 to 155 amino acid residue, especially exactly 148, 149 or 150 amino acid residues, downstream of the start of sub-sequence SEQ ID NO. 3 in such 3-ketoacyl-CoA synthase enzymes.

In some embodiments in which sub-sequence SEQ ID NO. 3 is present, the 3-ketoacyl-CoA synthase is at least 50%, at least 75%, at least 80%, at least 90% or at least 95% identical to any of SEQ ID NO. 42, provided that an amino acid residue of the 3-ketaoacyl-CoA synthase that aligns to amino acid residue 186 of SEQ ID NO. 42 is any one of isoleucine, methionine leucine, threonine, cysteine, valine, glutamine, phenylalanine, aspartic acid, asparagine and tyrosine.

In some embodiments in which sub-sequence SEQ ID NO. 3 is present, the 3-ketoacyl-CoA synthase is at least 50%, at least 75%, at least 80%, at least 90% or at least 95% identical to any of SEQ ID NO. 43, provided that an amino acid residue of the 3-ketoacyl-CoA synthase that aligns to amino acid residue 186 of SEQ ID NO. 43 is isoleucine.

In some embodiments in which sub-sequence SEQ ID NO. 3 is present, the 3-ketoacyl-CoA synthase has SEQ ID NO. 42 or SEQ ID NO. 43.

In some embodiments in which sub-sequence SEQ ID NO. 3 is present, the 3-ketoacyl-CoA synthase has SEQ ID NO. 42, wherein:
a) amino acid residue 186 is any one of isoleucine, threonine, cysteine, valine, glutamine, phenylalanine, aspartic acid, asparagine or tyrosine;
b) amino acid residue 186 is any one of isoleucine, threonine, cysteine, valine, glutamine, phenylalanine, aspartic acid, asparagine or tyrosine, and amino acid residue 241 is any one of methionine, phenylanaline, glutamic acid, leucine, tyrosine or aspartic acid;
c) amino acid residue 186 is any one of isoleucine, threonine, cysteine, valine, glutamine, phenylalanine, aspartic acid, asparagine or tyrosine, and amino acid residue 239 is any one of glutamine, aspartic acid or asparagine;
d) amino acid residue 186 is any one of isoleucine, threonine, cysteine, valine, glutamine, phenylalanine, aspartic acid, asparagine or tyrosine, and amino acid residue 246 is any of lysine or arginine;
e) amino acid residue 186 is any one of isoleucine, threonine, cysteine, valine, glutamine, phenylalanine, aspartic acid, asparagine or tyrosine, amino acid residue 239 is any one of glutamine, aspartic acid or asparagine and amino acid residue 241 is any one of methionine, phenylanaline, glutamic acid, leucine, tyrosine or aspartic acid;
f) amino acid residue 186 is any one of isoleucine, threonine, cysteine, valine, glutamine, phenylalanine, aspartic acid, asparagine or tyrosine, amino acid residue 239 is any one of glutamine, aspartic acid, tyrosine or asparagine and amino acid residue 246 is any one of lusine and arginine;
g) amino acid residue 186 is any one of isoleucine, threonine, cysteine, valine, glutamine, phenylalanine, aspartic acid, asparagine or tyrosine, amino acid residue 241 is any one of methionine, phenylanaline, glutamic acid or aspartic acid and amino acid residue 246 is any one of lysine and arginine; or
h) amino acid residue 186 is any one of isoleucine, threonine, cysteine, valine, glutamine, phenylalanine, aspartic acid, asparagine or tyrosine, amino acid residue 243 is glutamic acid and amino acid residue 246 is any one of histidine, lysine and arginine.

In some embodiments, the 3-ketoacyl-CoA synthase includes a sub-sequence SEQ ID. NO. 170, or a sub-sequence at least 80% identical to SEQ ID NO. 170, provided that (1) an amino acid residue of the 3-ketoacyl-CoA that aligns to amino acid residue 1 of SEQ ID NO. 170 is any one of alanine, cysteine, aspartic acid, glutamic acid, phenylalanine, histidine, isoleucine, lysine, leucine, methionine, asparagine, proline, glutamine, serine, threonine, tryptophan or tyrosine and (2) an amino acid residue of the 3-ketoacyl-CoA that aligns to amino acid residue 4 of SEQ ID NO. 170 is valine or alanine. SEQ ID NO. 170 differs from SEQ ID NO. 171 in that the glycine in amino acid position 1 of SEQ ID NO. 171 is replaced in SEQ ID NO. 170 with any one of alanine, cysteine, aspartic acid, glutamic acid, phenylalanine, histidine, isoleucine, lysine, leucine, methionine, asparagine, proline, glutamine, serine, threonine, tryptophan or tyrosine, and further in that the amino acid in position 4 may be valine. SEQ ID NO. 171 represents a sub-sequence found in a range of naturally-occurring 3-ketoacyl-CoA synthases. SEQ ID NO. 171 appears, for example in the naturally-occurring 3-ketoacyl-CoA synthases of *Acinetobacter schindleri* CIP 107287 (as amino acid residues 51-60 of SEQ ID NO. 8 with amino acid residue 55 being glutamic acid); *Acinetobacter schindleri* NIPH 900 (as amino acid residues 51-60 of SEQ ID NO. 86 with amino acid residue 55 being glutamic acid); *Acinetobacter* johnsii SH046 (as amino acid residues 51-60 of SEQ ID NO. 35 with amino acid residue 55 being glutamic acid); *Acinetobacter lwoffii* SH145 (as amino acid residues 51-60 of SEQ ID NO. 88 with amino acid residue 5 being aspartic acid); *Acinetobacter* sp NIPH 713 (as amino acid residues 51-60 of SEQ ID NO. 89 with amino acid residue 55 being glutamic acid).

In some embodiments, the 3-ketoacyl-CoA synthase includes a sub-sequence SEQ ID. NO. 50, or a sub-sequence at least 80% identical to SEQ ID NO. 50, provided that an amino acid residue of the 3-ketoacyl-CoA that aligns to amino acid residue 4 of SEQ ID NO. 50 is arginine. SEQ ID NO. 50 differs from SEQ ID NO. 108 in that the lysine of SEQ ID NO. 108 is replaced in SEQ ID NO. 50 with arginine. SEQ ID NO. 108 represents a sub-sequence found in a range of naturally-occurring 3-ketoacyl-CoA synthases. SEQ ID NO. 108 appears, for example in the naturally-occurring 3-ketoacyl-CoA synthases of *Acinetobacter schindleri* CIP 107287 (as amino acid residues 275-281 of SEQ ID NO. 8 with amino acid residue 280 being glutamine); *Acinetobacter schindleri* NIPH 900 (as amino acid residues 275-281 of SEQ ID NO. 86 with amino acid residue 279 being glutamine); *Acinetobacter* johnsii SH046 (as amino acid residues 275-281 of SEQ ID NO. 35 with amino acid residue 280 being asparagine); *Acinetobacter lwoffii* SH145 (as amino acid residues 274-280 of SEQ ID NO. 88 with amino acid residue 279 being glutamine); *Acinetobacter* sp NIPH 713 (as amino acid residues 274-280 of SEQ ID NO. 89 with amino acid residue 279 being glutamine). This substitution of the lysine has been found to increase fatty acid production rates (and production rates of fatty acid derivatives).

A 3-ketoacyl-CoA synthase that includes sub-sequence SEQ ID NO. 50 in some embodiments includes at least one sub-sequence selected from SEQ ID NO. 51, SEQ ID NO. 4, SEQ ID NO. 5 and SEQ ID NO. 6, or any combination of any two or more thereof. The 3-ketoacyl-CoA synthase preferably includes each of sub-sequences SEQ ID NOs. 51, 4, 5 and 6. When sub-sequence SEQ ID NO. 4 is present, it is preferably upstream from sub-sequence SEQ ID NO. 50. The start of sub-sequence SEQ ID NO. 4 may be, for example, from 120 to 130, 122 to 128, or 124 to 125 amino acid residues upstream of the start of sub-sequence SEQ ID NO. 50. When sub-sequence SEQ ID NO. 51 is present, it is preferably upstream from sub-sequence SEQ ID NO. 50. The start of sub-sequence SEQ ID NO. 51 may be, for example, 93 to 103, 95 to 100, or 97 to 98 amino acid residues upstream of the start of sub-sequence SEQ ID NO. 50. When sub-sequence SEQ ID NO. 5 is present, it is preferably downstream from sub-sequence SEQ ID NO. 50. The start of sub-sequence SEQ ID NO. 5 may be, for example, 10 to 20, 12-18, or exactly 15 amino acid residues downstream of the start of sub-sequence SEQ ID NO. 50. When sub-sequence SEQ ID NO. 6 is present, it is preferably downstream from sub-sequence SEQ ID NO. 50. The start of sub-sequence SEQ ID NO. 5 may be, for example, 45 to 56, 49 to 53, or exactly 51 amino acid residues downstream of the start of sub-sequence SEQ ID NO. 50.

A 3-ketoacyl-CoA synthase that includes sub-sequence SEQ ID NO. 50 may also include any one or more of sub-sequence SEQ ID NO. 52, sub-sequence SEQ ID NO. 53, sub-sequence SEQ ID NO. 46, sub-sequence SEQ ID NO. 48 (provided amino acid residue 278 is arginine) or subsequence SEQ ID NO. 110 (again provided amino acid residue 278 is arginine. The start of said sub-sequence SEQ ID NO. 52 or 53 may be 120 to 130, 122 to 128 or 124 to 126 amino acid residues upstream of the start of sub-sequence SEQ ID NO. 50. The start of sub-sequence SEQ ID NO. 52 may be 120 to 130, 122 to 128 or 124-126 amino acid residues upstream of the start of sub-sequence SEQ ID NO. 50. The start of sub-sequence SEQ ID NO. 46 may be, for example, 10 to 20, 12-18, or exactly 15 amino acid residues downstream of the start of sub-sequence SEQ ID NO. 50. A 3-ketoacyl-CoA synthase that includes sub-sequence SEQ ID NO. 50 may include sub-sequence SEQ ID NO. 54, provided that amino acid residue 129 of SEQ ID NO. 54 is arginine.

A 3-ketoacyl-CoA synthase sub-sequence that includes SEQ ID NO. 50 may include SEQ ID NO. 55, or include a sequence at least 50%, at least 75%, at least 80%, at least 90% or at least 95% identical to SEQ ID NO. 55, provided that an amino acid residue of the 3-ketoacyl-CoA that aligns to amino acid residue 278 in SEQ ID NO. 55 is arginine. A 3-ketoacyl-CoA synthase sub-sequence that includes SEQ ID NO. 50 may have SEQ ID NO. 111, or be at least 50%, at least 75%, at least 80%, at least 90% or at least 95% identical to SEQ ID NO. 111, provided that an amino acid residue of the 3-ketoacyl-CoA that aligns to amino acid residue 278 in SEQ ID NO. 111 is arginine.

In some embodiments, the 3-ketoacyl-CoA synthase includes a sub-sequence SEQ ID. NO. 56, or a sub-sequence at least 80% identical to SEQ ID NO. 56, provided that an amino acid residue of the 3-ketoacyl-CoA that aligns to amino acid residue 6 of SEQ ID NO. 56 is alanine. As will be seen by comparing the sequences, SEQ ID NO. 56 differs from SEQ ID NO. 109 in that the valine in amino acid residue position 6 of SEQ ID NO. 109 is replaced in SEQ ID NO. 56 with alanine. SEQ ID NO. 109 represents a sub-sequence found in a range of naturally-occurring 3-ketoacyl-CoA synthases. SEQ ID NO. 109 appears, for example in the naturally-occurring 3-ketoacyl-CoA synthases of *Acinetobacter schindleri* CIP 107287 (as amino acid residues 291-300 of SEQ ID NO. 8 and *Acinetobacter schindleri* NIPH 900 (as amino acid residues 291-300 of SEQ ID NO. 86. This substitution of the valine by alanine has been found to increase fatty acid production rates (and production rates of fatty acid derivatives).

A 3-ketoacyl-CoA synthase that includes sub-sequence SEQ ID NO. 56 in some embodiments includes at least one sub-sequence selected from SEQ ID NO. 51, SEQ ID NO. 4, and SEQ ID NO. 6, or any combination of any two or more thereof. The 3-ketoacyl-CoA synthase preferably includes each of sub-sequences SEQ ID NOs. 51, 4, and 6. The start of sub-sequence SEQ ID NO. 51 may be 109 to 120, 112 to 116 or 114 amino acid residues upstream from the start of sub-sequence SEQ ID NO. 56. The start of sub-sequence SEQ ID NO. 4 may be 135 to 148, 139 to 143 or 141 amino acid residues upstream from the start of sub-sequence SEQ ID NO. 56. The start of sub-sequence SEQ ID NO. 6 may be 30 to 40, 33 to 37 or 35 amino acid residues downstream from the start of sub-sequence SEQ ID NO. 56.

A 3-ketoacyl-CoA synthase that includes sub-sequence SEQ ID NO. 56 may also include any one or more of sub-sequence SEQ ID NO. 52, sub-sequence SEQ ID NO. 53, or sub-sequence SEQ ID NO. 48. The start of sub-sequence SEQ ID NO. 52 or 53 may be 135 to 148, 139 to 143 or 141 amino acid residues upstream from the start of sub-sequence SEQ ID NO. 56. The start of sub-sequence SEQ ID NO. 48 may be 285 to 295, 288 to 292 or 290 amino acid residues upstream from the start of sub-sequence SEQ ID NO. 56. A 3-ketoacyl-CoA synthase that includes sub-sequence SEQ ID NO. 56 may include sub-sequence SEQ ID NO. 58.

A 3-ketoacyl-CoA synthase sub-sequence that includes SEQ ID NO. 56 may have SEQ ID NO. 59, or be at least 50%, at least 75%, at least 80%, at least 90% or at least 95% identical to SEQ ID NO. 59, provided that an amino acid residue of the 3-ketoacyl-CoA that aligns to amino acid residue 296 in SEQ ID NO. 59 is alanine. A 3-ketoacyl-CoA synthase sub-sequence that includes SEQ ID NO. 56 may have SEQ ID NO. 112, or be at least 50%, at least 75%, at least 80%, at least 90% or at least 95% identical to SEQ ID NO. 112, provided that an amino acid residue of the 3-ketoacyl-CoA that aligns to amino acid residue 296 in SEQ ID NO. 112 is alanine.

In some embodiments, the 3-ketoacyl-CoA synthase includes a sub-sequence SEQ ID. NO. 60, or a sub-sequence at least 80% identical to SEQ ID NO. 60, provided that an amino acid residue of the 3-ketoacyl-CoA that aligns to amino acid residue 2 of SEQ ID NO. 60 is leucine and an amino acid residue of the 3-ketoacyl-CoA that aligns to amino acid residue 10 of SEQ ID NO. 60 is glutamine. As will be seen by comparing the sequences, SEQ ID NO. 60 differs from SEQ ID NO. 116 in that the methionine in amino acid residue position 2 of SEQ ID NO. 116 is replaced in SEQ ID NO. 60 with leucine. SEQ ID NO. 116 represents a sub-sequence found in a range of naturally-occurring 3-ketoacyl-CoA synthases. SEQ ID NO. 116 appears, for example in the naturally-occurring 3-ketoacyl-CoA synthases of Acinetobacter schindleri CIP 107287 (as amino acid residues 177-190 of SEQ ID NO. 8 and Acinetobacter schindleri NIPH 900 (as amino acid residues 177-190 of SEQ ID NO. 86). This substitution of the methionine by leucine has been found to increase fatty acid production rates (and production rates of fatty acid derivatives).

A 3-ketoacyl-CoA synthase that includes sub-sequence SEQ ID NO. 60 may further include sub-sequence SEQ ID NO. 4. The start of sub-sequence SEQ ID NO. 4 may be 22 to 32, 25 to 29 or 27 amino acid residues upstream of the start of sub-sequence SEQ ID NO. 60. Such a 3-ketoacyl-CoA synthase may have a sub-sequence SEQ ID NO. 61 or sub-sequence SEQ ID NO. 62.

A 3-ketoacyl-CoA synthase that includes sub-sequence SEQ ID NO. 60 in some embodiments includes at least one sub-sequence selected from SEQ ID NO. 5 and SEQ ID NO. 6. The start of sub-sequence SEQ ID NO. 5 may be 109 to 120, 11 to 115 or 112 to 113 amino acid residues downstream of the start of sub-sequence SEQ ID NO. 60. The start of sub-sequence SEQ ID NO. 6 may be 143 to 153, 146 to 151 or 148 to 149 amino acid residues upstream of the start of sub-sequence SEQ ID NO. 60. The 3-ketoacyl-CoA synthase preferably includes each of sub-sequences SEQ ID NOs. 4, 5 and 6.

A 3-ketoacyl-CoA synthase that includes sub-sequences SEQ ID NO. 60, SEQ ID NO. 4, SEQ ID NO. 5 and SEQ ID NO. 6 may include a sub-sequence SEQ ID NO. 63.

A 3-ketoacyl-CoA synthase that includes sub-sequence SEQ ID NO. 60 may also include a sub-sequence SEQ ID NO. 48. The start of sub-sequence SEQ ID NO. 48 may be 173 to 183, 175 to 179 or 177 amino acid residues upstream from the start of sub-sequence SEQ ID NO. 60. A 3-ketoacyl-CoA synthase sub-sequence that includes SEQ ID NO. 60 may include SEQ ID NO. 64, or include a sequences that is at least 50%, at least 75%, at least 80%, at least 90% or at least 95% identical to SEQ ID NO. 64, provided that amino acid residue in position 178 is leucine and the amino acid residue in position 186 is glutamine. A 3-ketoacyl-CoA synthase sub-sequence that includes SEQ ID NO. 60 may have SEQ ID NO. 113, or be at least 50%, at least 75%, at least 80%, at least 90% or at least 95% identical to SEQ ID NO. 113, provided that amino acid residue in position 178 is leucine and the amino acid residue in position 186 is glutamine.

In some embodiments, the 3-ketoacyl-CoA synthase includes a sub-sequence SEQ ID. NO. 65, or a sub-sequence at least 80% identical to SEQ ID NO. 65, provided that an amino acid residue of the 3-ketoacyl-CoA that aligns to amino acid residue in position 2 of SEQ ID NO. 65 is alanine. As will be seen by comparing the sequences, SEQ ID NO. 65 differs from SEQ ID NO. 97 in that the valine in amino acid residue position 2 of SEQ ID NO. 97 is replaced in SEQ ID NO. 65 with alanine. SEQ ID NO. 97 represents a sub-sequence found in a range of naturally-occurring 3-ketoacyl-CoA synthases. SEQ ID NO. 97 appears, for example in the naturally-occurring 3-ketoacyl-CoA synthases of Acinetobacter schindleri CIP 107287 (as amino acid residues 316-331 of SEQ ID NO. 8 with amino acid residue 319 being leucine and amino acid residue 322 being aspartic acid); Acinetobacter schindleri NIPH 900 (as amino acid residues 316-331 of SEQ ID NO. 86 with amino acid residue 319 being leucine and amino acid residue 322 being aspartic acid; Acinetobacter johnsii SH046 (as amino acid residues 316-331 of SEQ ID NO. 35 with amino acid residue 319 being isoleucine and amino acid residue 322 being aspartic acid); Acinetobacter lwoffii SH145 (as amino acid residues 315-330 of SEQ ID NO. 88 with amino acid residue 318 being isoleucine and amino acid residue 321 being asparagine); Acinetobacter sp NIPH 713 (as amino acid residues 315-330 of SEQ ID NO. 89 with amino acid residue 318 being methionine and amino acid residue 321 being asparagine. This substitution of the valine with alanine has been found to increase fatty acid production rates (and production rates of fatty acid derivatives).

A 3-ketoacyl-CoA synthase that includes sub-sequence SEQ ID NO. 65 may further include sub-sequence SEQ ID NO. 5. The start of sub-sequence SEQ ID NO. 65 may be 20 to 31, 24 to 28 or 26 amino acid residues upstream from the start of sub-sequence SEQ ID NO. 65. A 3-ketoacyl-CoA synthase that includes sub-sequence SEQ ID NO. 65 and sub-sequence SEQ ID NO. 5 may include sub-sequence SEQ ID NO. 66.

A 3-ketoacyl-CoA synthase that includes sub-sequence SEQ ID NO. 65 may further include sub-sequence SEQ ID NO. 51. The start of sub-sequence SEQ ID NO. 51 may be 134-144, 136 to 140 or 138 to 139 amino acid residues upstream from the start of sub-sequence SEQ ID NO. 65.

A 3-ketoacyl-CoA synthase that includes sub-sequence SEQ ID NO. 65 may include sub-sequence SEQ ID NO. 4. A 3-ketoacyl-CoA synthase that includes sub-sequence SEQ ID NO. 65 and sub-sequence SEQ ID NO. 4 may include sub-sequence SEQ ID NO. 53 or sub-sequence SEQ ID NO. 67. The start of sub-sequence SEQ ID NO. 4, 53 or 67 may be 160 to 170, 163 to 168 or 165 to 166 amino acid residues upstream from the start of sub-sequence SEQ ID NO. 65.

A 3-ketoacyl-CoA synthase that includes sub-sequence SEQ ID NO. 65 may further include either sub-sequence SEQ ID NO. 48. The start of sub-sequence SEQ ID NO. 48, may be 310 to 320, 313 to 316, or 314 to 315 amino acid residues upstream from the start of sub-sequence SEQ ID NO. 65. A 3-ketoacyl-CoA synthase that includes sub-sequence SEQ ID NO. 65 may include sub-sequence SEQ ID NO. 68 or a sub-sequence at least 50%, at least 75%, at least 80%, at least 90% or at least 95% identical to SEQ ID NO. 68, provided that an amino acid residue of the 3-ketoacyl-CoA that aligns to amino acid residue 317 of SEQ ID NO. 68 is alanine. A 3-ketoacyl-CoA synthase that includes sub-sequence SEQ ID NO. 65 may have SEQ ID NO. 114 or be at least 50%, at least 75%, at least 80%, at least 90% or at least 95% identical to SEQ ID NO. 114, provided that an amino acid residue of the 3-ketoacyl-CoA that aligns to amino acid residue 317 of SEQ ID NO. 114 is alanine.

In some embodiments, the 3-ketoacyl-CoA synthase includes a sub-sequence SEQ ID. NO. 69, or a sub-sequence at least 80% identical to SEQ ID NO. 69, provided that an amino acid residue of the 3-ketoacyl-CoA that aligns to amino acid residue in position 6 of SEQ ID NO. 69 is isoleucine. As will be seen by comparing the sequences, SEQ ID NO. 69 differs from SEQ ID NO. 107 in that the methionine in amino acid residue position 6 of SEQ ID NO. 107 is replaced in SEQ ID NO. 69 with isoleucine. SEQ ID NO. 107 represents a sub-sequence found in a range of naturally-occurring 3-ketoacyl-CoA synthases. SEQ ID NO. 107 appears, for example in the naturally-occurring 3-ketoacyl-CoA synthases of *Acinetobacter schindleri* CIP 107287 (as amino acid residues 266-274 of SEQ ID NO. 8 with amino acid residue 268 being valine and amino acid residue 274 being lysine); *Acinetobacter schindleri* NIPH 900 (as amino acid residues 266-274 of SEQ ID NO. 86 with amino acid residue 268 being valine and amino acid residue 274 being lysine); *Acinetobacter johnsii* SH046 (as amino acid residues 266-274 of SEQ ID NO. 35 with amino acid residue 268 being valine and amino acid residue 274 being alanine); *Acinetobacter lwoffii* SH145 (as amino acid residues 265-273 of SEQ ID NO. 88 with amino acid residue 267 being valine and amino acid residue 273 being alanine); *Acinetobacter* sp NIPH 713 (as amino acid residues 265-273 of SEQ ID NO. 89 with amino acid residue 267 being valine and amino acid residue 273 being alanine). This substitution of the methionine with isoleucine has been found to increase fatty acid production rates (and production rates of fatty acid derivatives).

A 3-ketoacyl-CoA synthase that includes sub-sequence SEQ ID NO. 69 may further include sub-sequence SEQ ID NO. 51. The start of sub-sequence SEQ ID NO. 51 may be 85 to 95, 87 to 91 or 88 to 89 amino acid residues upstream from the start of sub-sequence SEQ ID NO. 69

A 3-ketoacyl-CoA synthase that includes sub-sequence SEQ ID NO. 69 may further include any or all of sub-sequence SEQ ID NOs. 4, 5 and 6. A 3-ketoacyl-CoA synthase that includes sub-sequence SEQ ID NO. 69 and sub-sequence SEQ ID NO. 4 may include sub-sequence SEQ ID NO. 52 or sub-sequence SEQ ID NO. 53. A 3-ketoacyl-CoA synthase that includes sub-sequence SEQ ID NO. 69, sub-sequence SEQ ID NO. 5 and sub-sequence SEQ ID NO. 6 may include sub-sequence SEQ ID NO. 46. A 3-ketoacyl-CoA synthase that includes sub-sequences SEQ ID NO. 69, 4, 5 and 6 may include sub-sequence SEQ ID NO. 70.

A 3-ketoacyl-CoA synthase that includes sub-sequence SEQ ID NO. 69 may include sub-sequence SEQ ID NO. 48. A 3-ketoacyl-CoA synthase that includes sub-sequence SEQ ID NO. 69 may include sub-sequence SEQ ID NO. 71 or include a sub-sequence at least 50%, at least 75%, at least 80% at least 90% or at least 95% identical to sub-sequence SEQ ID NO. 71, provided that an amino acid residue of the 3-ketoacyl-CoA that aligns to amino acid residue 271 of SEQ ID NO. 71 is isoleucine. Such a 3-ketoacyl-CoA synthase may have SEQ ID NO. 115 or be at least 50%, at least 75%, at least 80% at least 90% or at least 95% identical to sub-sequence SEQ ID NO. 115, provided that an amino acid residue of the 3-ketoacyl-CoA that aligns to amino acid residue 271 of SEQ ID NO. 115 is isoleucine.

Further Reaction Steps in the Non-Native Fatty Acid Synthesis Pathway

The reaction of acyl-CoA with malonyl-CoA produces a 3-ketoacyl-CoA compound that must be reduced to the corresponding acyl compound before it can condense with another molecule of malonyl-CoA to extend the chain. The reduction takes place in three steps, the first being the reduction of the 3-ketoacyl group to the corresponding 3-hydroxyacyl group. The second reaction is a dehydration to the corresponding 3-enoylacyl compound, which is reduced in a third step to the corresponding acyl-CoA. The first reaction step is enzymatically catalyzed by a keto-CoA reductase (KCR) enzyme (EC 1.1.1.35). The second step is enzymatically catalyzed by a 3-hydroxy-acyl-CoA dehydratase (3HDh) enzyme (EC 4.2.1.17). Some bifunctional enzymes catalyze both of the first and second step reactions (EC 1.1.1.35 and EC 4.2.1.55). The third reaction step is enzymatically catalyzed by an enoyl-CoA reductase (ECR) enzyme (EC 1.1.1.32).

Accordingly, the genetically modified cell preferably further comprises at least one of (1) a heterologous KCR gene that encodes for a KCR enzyme; (2) a heterologous 3HDh gene that encodes for a 3HDh enzyme; (3) a heterologous gene that encodes for a bifunctional enzyme that catalyzes both of the first and second reaction steps (EC 1.1.1.35 and 4.1.2.55) and (4) a heterologolous ECR gene that encodes for an ECR enzyme. Preferably, the genetically modified cell contains at least (1), (2) and (4) or at least (3) and (4). In each case, the gene preferably is under the control of promoter and/or terminator sequences active in the host cell.

The KCR enzyme may be, for example, one encoded by a *P. aeruginosa* pafadB gene and/or having an amino acid sequence at least 80%, at least 90%, at least 95%, at least 99% or 100% identical to SEQ. ID. NO. 103, one encoded by a *P. aeruginosa* fadG gene and/or having an amino acid sequence at least 80%, at least 90%, at least 95%, at least 99% or 100% identical to SEQ. ID. NO. 102, one encoded by a *C. beijerinckii* hbd gene and/or having an amino acid sequence at least 80%, at least 90%, at least 95%, at least 99% or 100% identical to SEQ. ID. NO. 101, and others as described in WO 2015/010103.

The 3HDh enzyme may be, for example, one encoded by a *C. acetobutylicum* crt (short-chain-enoyl-CoA hydratase) gene and/or having an amino acid sequence at least 80%, at least 90%, at least 95%, at least 99% or 100% identical to SEQ. ID. NO. 99, one encoded by a *P. putida* ech (enoyl-CoA hydratase/aldolase) gene and/or having an amino acid sequence at least 80%, at least 90%, at least 95%, at least 99% or 100% identical to SEQ. ID. NO. 100, and others as described in WO 2015/010103.

Suitable bifunctional enzymes that catalyse both the first and second reactions steps include, for example, one encoded by an *E. coli* fadB gene and/or having an amino acid sequence at least 80%, at least 90%, at least 95%, at least 99% or 100% identical to SEQ. ID. NO. 98; one encoded by an R. novegicus ech2 gene, and others as described in WO 2015/010103.

Suitable ECR enzymes include, for example, one encoded by a *T. denticola* ter gene and/or having an amino acid sequence at least 80%, at least 90%, at least 95%, at least 99% or 100% identical to SEQ. ID. NO. 84.

The genetically modified cell of the invention in some embodiments further includes at least one heterologous 3-ketobutyryl-CoA synthase gene, different from the modified 3-ketoacyl-CoA synthases described above, which encodes for a 3-ketobutyryl-CoA synthase. The heterologous 3-ketobutyryl-CoA synthase gene may encode for a 3-ketobutyryl-CoA synthase enzyme that is at least 80%, at least 90%, at least 95%, at least 99% or 100% identical to any of those identified as SEQ ID NOs. 1-120 of WO 2015/10103.

In some embodiments, the heterologous 3-ketobutyryl-CoA synthase gene is a *Streptomyces* Sp CL190 gene and/or a gene that encodes for an NphT7 enzyme that is at least 80%, at least 90%, at least 95%, at least 99% or 100% identical to SEQ ID NO. 83.

In some embodiments, the genetically modified cell of the invention includes at least one gene that encodes for a modified NphT7 enzyme as described in WO 2015/10103. The modified NphT7 enzyme comprises an amino acid sequence having at least 70% but less than 100% to SEQ ID NO. 83. The modified NphT7 enzyme may have, for example, one or more amino acid substitutions selected from the group consisting of H100L, I147T, F217V, Y144L, V157F, G309S, G288S, a PDRP to HFLQ substitution for amino acid residues 86-89, I147F, I147M, I147Q, I147S, I147C, 1147E, I147N, I147W, I147D, I147R, I147P, I147L, V196G, I147G, I147H, I1147K, I147V, I147A, I147Y, F217G, F217A, F217L, F217I, F217M, F217T, F217P, F217S, F217E, F217L, F217V, F217W, S323A and S323V, and any combination of any two or more thereof.

In some embodiments, the modified NphT7 enzyme comprises at least one amino acid substitution selected from the group consisting of I147V, I147S, I147T, and at least one additional amino acid substitution selected from H100L, F217V, S323A and S323V. In some embodiments, the modified NphT7 enzyme corresponds to SEQ ID NO. 82. In some embodiments, the modified NphT7 enzyme comprises an I147V, I147S or I147T amino acid substitution and an S323A amino acid substitution (corresponding to SEQ ID NO. 82 in which amino acid 100 is H, amino acid 147 is V, S or T, amino acid 217 is F and amino acid 323 is A). In some embodiment, the modified NphT7 enzyme comprises an H100L substitution, an I147V, I147S or I147T amino acid substitution, an F217V substitution and an S323A amino acid substitution (corresponding to SEQ ID NO. 82 in which amino acid residue 100 is L, amino acid residue 147 is V, S or T, amino acid residue 217 is V and amino acid residue 323 is A).

In certain embodiments, the genetically modified cell of the invention includes both of (1) a *Streptomyces* Sp CL190 nphT7 gene and/or a gene that encodes for an NphT7 enzyme that is at least 80%, at least 90%, at least 95%, at least 99% or 100% identical to SEQ ID NO. 83 and (2) a modified NphT7 enzyme having one or more amino acid substitutions selected from the group consisting of H100L, I147T, F217V, Y144L, V157F, G309S, G288S, a PDRP to HFLQ substitution for amino acid residues 86-89, I147F, I147M, I147Q, I147S, I147C, 1147E, I147N, I147W, I147D, I147R, I147P, I147L, V196G, I147G, I147H, I1147K, I147V, I147A, I147Y, F217G, F217A, F217L, F217I, F217M, F217T, F217P, F217S, F217E, F217L, F217V, F217W, S323A and S323V, and any combination of any two or more thereof. In preferred embodiments, the genetically modified cell includes a gene that encodes for an enzyme having SEQ ID NO. 83 and another gene that encodes for an enzyme having SEQ ID. NO. 82. In especially preferred embodiments, the genetically modified cell includes a gene that encodes for an enzyme having SEQ ID NO. 83 and another gene that encodes for an enzyme having SEQ ID. NO. 82 in which amino acid residue 100 is H or L, amino acid residue 147 is S, T or V, amino acid residue 271 is F or V and amino acid residue 323 is A.

The genetically modified cell of the invention produces one or more enzymes that terminate the acyl elongation cycle and produce a product having the desired chain length. Such a termination enzyme may or may not be heterologous. The selection of termination enzyme may depend on whether the desired product is a fatty acid or a derivative thereof such as a fatty alcohol, a fatty aldehyde, a fatty alkene, a fatty amide, a fatty ester or a fatty alkane.

The cell of the invention in some embodiments includes a heterologous thioesterase gene that encodes for a thioesterase such as an acyl-CoA esterase, in which case the product will be a fatty acid. Suitable thioesterases include those described in Table 11 of WO 2015/101013.

In some embodiments the cell of the invention includes a gene that encodes for an ester synthase, in which case the product typically is a fatty acid ester. Suitable ester synthases have amino acid sequences at least 80%, at least 90%, at least 95%, at least 99% or at least 100% identical to any of the *Marinobacter aquacolei* Maq1 enzyme (SEQ ID NO. 289 of WO 2015/10103), the *Psychrobacter cryohaloentis* Pcry1 enzyme (SEQ ID NO 290 of WO 2015/10103), the *Rhodococcus jostii* Rjos1 enzyme (SEQ ID NO 291 of WO 2015/10103), the, *Alcanivorax borkumensis* strain SK2 Abork1 enzyme (SEQ ID NO 292 of WO 2015/10103) and the *Hahella chejuensis* hche gene (SEQ ID NO. 104). The ester synthase may have an amino acid sequence at least 80%, at least 90%, at least 95%, at least 99% or at least 100% identical to the *Hahella chejuensis* Hche ester synthase (SEQ ID NO. 104).

The genetically modified cell of the invention may also include one or more genes that encode for one or more of a fatty acyl-CoA reductase (alcohol or aldehyde forming), a fatty aldehyde reductase, an acyl-ACP reductase, an acyl-CoA:ACP acyltransferase, an acyl-CoA hydrolase, a carboxylic acid reductase, an aldehyde dehydrogenase and/or an acyl-ACP reductase.

The genetically modified cell of the invention also may include (A) one or more genes that encode for a carboxyl transferase subunit a enzyme, (EC 6.3.1.2) such as an *E. coli* accA enzyme or an enzyme that is at least 80%, at least 90%, at least 95% or at least 99% identical thereto; (B) one or more genes that encode for a biotin carboxyl carrier protein, (EC 6.4.1.2) such as an *E. coli* accB enzyme or an enzyme that is at least 80%, at least 90%, at least 95% or at least 99% identical thereto; (C) one or more genes that encode for a biotin carboxylase subunit enzyme, (EC 6.3.4.14) such as an *E. coli* accC enzyme or an enzyme that is at least 80%, at least 90%, at least 95% or at least 99% identical thereto; (D) a carboxyl transferase subunit (3 (EC 6.4.1.2), such as an *E.*

*coli* accD enzyme or an enzyme that is at least 80%, at least 90%, at least 95% or at least 99% identical thereto, or a combination of any two or more thereof. In some embodiments, all of (A)-(D) are present.

In some embodiments, the genetically modified cell of the invention further comprises one or more additional genetic modifications that fully or partially inhibit the production of one or more of the following enzymes:

Methylglyoxal synthase (EC 4.2.3.3), for example that encoded by the *E. coli* mgsA gene.

Lactate dehydrogenase (EC 1.1.1.27), for example that encoded by the *E. coli* ldhA gene.

Phosphotransacetylase (EC 2.3.1.8), for example that encoded by the *E. coli* pta gene.

Acetate kinase (EC 2.7.2.1), for example that encoded by *E. coli* ackA gene.

Acyl-CoA synthase (EC 6.2.1.3), for example that encoded by the *E. coli* fadD gene.

Pyruvate formate lyase (EC 2.3.1.54), for example that encoded by the *E. coli* pflB gene.

Pyruvate oxidase (EC 1.2.2.2), for example that encoded by the *E. coli* poxB gene.

Fused acetaldehyde-CoA dehydrogense (EC 1.2.1.10).

Trigger factor (EC 5.2.1.8), for example that encoded by the *E. coli* tig gene.

Restriction endonuclease (EC 3.1.21.3), for example that encoded by the *E. coli* hsdr514 gene.

The atoDAEB operon.

Acyl-CoA thioesterase (EC 3.1.2.-), for example that encoded by the *E. coli* tesB or yciA gene.

Acyl-coenzyme A dehydrogenase (EC 1.3.8.7), for example that encoded by the *E. coli* fadE gene.

3-ketoacyl-CoA thiolase (EC 2.3.1.16), for example that encoded by the *E. coli* fadA gene.

L-ribulokinase (EC2.7.1.16), for example that encoded by the *E. coli* araB gene.

L-ribulose-5-phosphate-4-epimerase (EC 5.1.3.4), for example that encoded by the *E. coli* araD gene.

Beta-D-galactosidase (EC 3.2.1.23), for example that encoded by the *E. coli* lacZ gene.

Lambda phase lysogen.

Rhamnulose-1-phosphate aldolase (EC 4.1.2.19), for example that encoded by the *E. coli* rhaD gene.

Rhamnulokinase (EC 2.7.1.5), for example that encoded by the *E. coli* rhaB gene.

F mating factor.

Rph-1 gene.

Other genetic modifications may be present in the cell, including any of those described in WO 2015/10103.

Any heterologous gene may be operatively linked to a promoter and/or terminator sequence that is functional in the host strain. The promoter may be an inducible promoter that functions only under certain conditions. For example, a low phosphate inducible promoter such as the promoter of the wild-type *E. coli* phoE gene (PphoE) promoter) is a useful promoter for the 3-ketoacyl synthase gene. Such a promoter is active in a low phosphate environment. Accordingly, a microorganism in which the 3-ketoacyl synthase gene of the invention is under the control of an *E. coli* phoE promoter or another low phosphate inducible promoter may be cultivated in a fermentation medium containing no more than 25 mM phosphate, especially no more than 20 mM, no more than 2 mM, no more than 1 mM, no more than 0.5 mM, or no more than 0.25 mM phosphate).

Any heterologous gene may be integrated into the genome of the host strain and/or present in one or more plasmids. If integrated into the genome, the heterologous gene may be inserted at a targeted or random location. Transformation methods such as electroporation and chemical methods (including calcium chloride and/or lithium acetate methods) known in the art are suitable. Examples of suitable transformation methods are described, for example, in *Molecular Cloning: A Laboratory Manual* 4$^{th}$ Ed. Spring Harbor Press 2012. In general, no special transformation methods are necessary to produce the genetically modified cells of the invention.

Deletions and/or disruptions of native genes can be performed by transformation methods, by mutagenesis and/or by forced evolution methods. In mutagenesis methods, cells are exposed to ultraviolet radiation or a mutagenic substance, under conditions sufficient to achieve a high kill rate (60-99.9%, preferably 90-99.9%) of the cells. Surviving cells are then plated and selected or screened for cells having the deleted or disrupted metabolic activity. Disruption or deletion of the desired native gene(s) can be confirmed through PCR or Southern analysis methods.

The genetically modified cells described herein are used to produce compounds having a straight-chain alkyl group. The cells are grown under conditions such that they produce such compounds, and the compounds are recovered.

When the host cell is a plant cell, the plant can be grown and the compound having the straight-chain alkyl group can be recovered from the plant or any portion thereof, such as roots, stems, leaves, flowers, seeds, seed pods and the like, in which the compound accumulates during the growth of the plant.

Single-cell and other microcells of the invention can be used in a culturing process to produce such compounds.

Culturing is performed generally by forming a culture medium that includes at least one carbon source that is capable of being metabolized by the cell to produce the product compounds and nutrients as may be required by the specific cell. The nutrients may include, for example, at least one nitrogen source such as yeast extract, peptone, tryptone, soy flour, corn steep liquor, or casein, at least one phosphorus source, one or more vitamins such as biotin, vitamin B12 and derivatives of vitamin B12, thiamin, pantothenate, one or more trace metals and the like. The fermentation medium may also contain additional materials such as anti-foam agents, biocides, buffers and the like.

In some cases, such as the production of fatty acid esters, the culture medium may also include a reagent that reacts with the straight-chain compound to produce the desired product. In the specific case of fatty acid esters, for example the culture medium preferably contains an alkanol such as methanol, ethanol or a C3-C8 alkanol. The alkanol reacts to produce the corresponding ester. A native or heterologous ester synthase, or other appropriate enzyme, may be expressed by the cell to catalyze such a reaction.

Generally, the culture medium is inoculated with the cell of the invention, and the inoculum is cultured in the medium so that the cell density increases to a cell density suitable for production. The culture medium is then maintained at conditions sufficient for the cells to produce the desired product.

Suitable culture conditions will of course depend on requirement of the particular host strain. The temperature of the culture medium may be, for example from 20° C. to 70° C., with a temperature of 25 to 40° C. being preferred for most cells.

The pH of the culture medium may be, for example, from 2.0 to 10.0, from 3.0 to 9.0 or from 6.0 to pH 8.5.

It is contemplated that embodiments of the present invention may be practiced using either batch, fed-batch or continuous processes and that any known mode of bioproduction would be suitable.

The culturing may be performed under aerobic, microaerobic, or anaerobic conditions, as required or can be tolerated by the particular cell.

Generally, no special culturing equipment is needed to perform the fermentation. The equipment may include, for example, a tank suitable for holding the cell and the culture medium; a line for discharging contents from the culture tank to an extraction and/or separation vessel; and an extraction and/or separation vessel suitable for removal of the chemical product from cell culture waste.

The carbon source is one or more carbon-containing compounds that can be metabolized by the cell of the invention as a source of carbon. Examples of suitable carbon sources include sugars such as glucose, sucrose, fructose, lactose, C-5 sugars such as xylose and arabinose, glycerol and polysaccharides such as starch and cellulose. Other suitable carbon sources include fermentable sugars as may be obtained from cellulosic and lignocellulosic biomass through processes of pretreatment and saccharification, as described, for example, in U.S. Patent Publication No. 2007/0031918A1, hemicellulose, lignin, starch, oligosaccharides and/or monosaccharides. Other suitable carbon sources include high-fructose corn syrup, cheese whey permeate, cornsteep liquor, sugar beet molasses, and barley malt. Still other suitable carbon sources include carbon dioxide, carbon monoxide, methanol, methylamine and glucosamine.

The culturing process may be continued until a titer of the desired product reaches at least 0.01, at least 0.05, at least 0.1, at least 0.25, at least 0.5 or at least 1 g per liter of culture medium (g/L). The fermentation process may be continued until the titer reaches, for example, up to 40, up to 45, up to 50, up to 80, up to 100, or up to 120 g/L. The specific productivity may be, for example, from 0.01 and 0.60 grams of the desired product per gram of cells on a dry weight basis per hour (g chemical product/g DCW-hr). The volumetric productivity achieved may be at least 0.005 g of the desired product per liter per hour (g/L-hr), at least 0.01 g/L-hr, at least 0.1 g/L-hr or at least 0.5 g/L-hr, and may be up to, for example, 10 g/L-hr, up to 5 g/L-hr or up to 1 g/L-hr. [0212] In some embodiments, specific productivity as measured over a 24-hour fermentation (culture) period may be greater than about 0.01, 0.05, 0.10, 0.20, 0.5, 1.0, 2.0, 3.0, 4.0, 5.0, 6.0, 7.0, 8.0, 9.0, 10.0, 11.0 or 12.0 grams of chemical product per gram DCW of cells (based on the final DCW at the end of the 24-hour period).

The following examples are provided to illustrate the invention, but are not intended to limit the scope thereof. All parts and percentages are by weight unless otherwise indicated.

EXAMPLES

The following host *E. coli* strains are used in the following examples as indicated.

Host Strain 1 is a mutant of the *E. coli* strain designated BW25113, available from the *E. coli* Genetic Strain Center (CGSC #7636; Dept. of Molecular, Cellular, and Developmental Biology, Yale University, New Haven, Conn.), having the following additional genetic modifications:

| Designation | Description |
| --- | --- |
| ΔldhA::frt | Deletion of native lactate dehydrogenase |
| ΔpflB::frt | Deletion of native pyruvate formate lyase |
| ΔmgsA::frt | Deletion of methylglyoxal synthase |
| ΔpoxB::frt | Deletion of pyruvate oxidase |
| Δpta-ack::frt | Deletion of phosphotransacetylase and acetate kinase |
| Δtig:frt | Deletion of trigger factor protein |
| ΔatoDAEB::frt | Deletion to disrupt short-chain poly-(R)-3-hydroxybutyrate synthesis |
| ΔfadD::frt | Deletion of native acyl-CoA synthase |
| ΔtesB::frt | Deletion of native thioesterase |
| ΔyciA:frt | Deletion of native thioesterase |
| fabI(ts)_zeo | Insertion of *E. coli* fabI gene encoding a protein having SEQ ID NO 85, except the serine at position 241 replaced by phenylalanine (S241F modification) and a zeomyin resistance marker at the 3' end and deletion of the wildtype fabI gene. |

Host Strain 2 is a mutant of the BW 25113 *E. coli* strain with the following additional genetic modifications:

| Designation | Description |
| --- | --- |
| ΔldhA::frt | Deletion of native lactate dehydrogenase |
| ΔpflB::frt | Deletion of native pyruvate formate lyase |
| ΔmgsA::frt | Deletion of methylglyoxal synthase |
| ΔpoxB::frt | Deletion of pyruvate oxidase |
| Δpta-ack::frt | Deletion of phosphotransacetylase and acetate kinase |
| Δtig:frt | Deletion of trigger factor protein |
| ΔatoDAEB::frt | Deletion to disrupt short-chain poly-(R)-3-hydroxybutyrate synthesis |
| ΔfadD::frt | Deletion of native acyl-CoA synthase |
| ΔtesB::frt | Deletion of native thioesterase |
| ΔyciA:Irt | Deletion of native thioesterase |
| Δadhe | Deletion of native aldehyde-alcohol dehydrogenase |
| fabI(ts) | Insertion of modified *E. coli* fabI gene encoding an enzyme having SEQ ID NO. 85, with the serine at position 241 replaced by phenylalanine (S241F modification), and deletion of the wildtype fabI gene |
| $P_{pstsIH}$-nphT7-ter-TT-loxP | Insertion of a gene encoding for *Streptomyces* Sp. CL190 acetoacetyl-CoA synthase (NphT7, SEQ. ID. NO. 83) and a gene encoding for *Treponema denticola* enoyl-CoA reductase (ter, SEQ. ID. NO. 84) under control of *E. coli* pstsIH promoter and an *E. coli* terminator at locus of native adhE gene |

Host Strain 3 is a mutant of the BW 25113 *E. coli* strain with the following genetic modifications:

| Designation | Description |
| --- | --- |
| ΔldhA::frt | Deletion of native lactate dehydrogenase |
| ΔpflB::frt | Deletion of native pyruvate formate lyase |
| ΔmgsA::frt | Deletion of methylglyoxal synthase |
| ΔpoxB::frt | Deletion of pyruvate oxidase |
| Δpta-ack::frt | Deletion of phosphotransacetylase and acetate kinase |
| Δtig:frt | Deletion of trigger factor protein |
| ΔatoDAEB::frt | Deletion to disrupt short-chain poly-(R)-3-hydroxybutyrate synthesis |
| ΔfadD::frt | Deletion of native acyl-CoA synthase |
| ΔtesB::frt | Deletion of native thioesterase |
| ΔyciA:frt | Deletion of native thioesterase |
| Δadhe | Deletion of native aldehyde-alcohol dehydrogenase |

-continued

| Designation | Description |
|---|---|
| P$_{pstsIH}$-nphT7-ter-TT-loxP | Insertion of a gene encoding for *Streptomyces* Sp. CL190 acetoacetyl-CoA synthase (NphT7, SEQ. ID. NO. 83) and a gene encoding for *Treponema denticola* enoyl-CoA reductase (ter, SEQ. ID. NO. 84) under control of *E. coli* pstsIH promoter and an *E. coli* terminator at locus of native adhE gene |

Production of 3-Ketoacyl-CoA Synthase Genes and Mutants 3-ketoacyl-CoA synthase genes are synthesized based on published sequence information for various wild type 3-ketoacyl-CoA synthase genes. Site-specific mutants of the synthesized 3-ketoacyl-CoA synthase genes are generated by oligonucleotide-directed mutagenesis. The sources used herein for the wild-type genes and the short-hand designations used herein for each of them and the amino acid sequence of the native enzyme produced by the wild-type genes are as follows:

| Source Species | Designation | Enzyme Encoded (wild-type strain) |
|---|---|---|
| *Acinetobacter schindleri* CIP 107287 | Asch | SEQ ID NO. 8 |
| *Acinetobacter schindleri* NIPH 900 | Asch-2 | SEQ ID NO. 86 |
| *Acinetobacter johnsonii* SH046 | Ajoh-2 | SEQ ID NO. 35 |
| *Acinetobacter lwoffii* SH145 | Alwo | SEQ ID NO. 88 |
| *Acinetobacter* sp. NIPH 713 | ANIP71 | SEQ ID NO. 89 |
| *Pseudomonas stutzeri* ATCC 17588 | Pstu | SEQ ID NO. 90 |
| *Alishewanella agri* BL06 | Aagr | SEQ ID NO. 91 |

In each case, the 3-ketoacyl-CoA synthase gene is fused to a DNA sequence encoding a protein fragment containing 6 histidine residues and a protease recognition site, and incorporated into a pET plasmid having a ColE1 origin of replication and a kanamycin resistance marker.

Mutations to the amino acid residues encoded by the wild-type genes are designated herein by the shorthand designation for the wild-type strain, followed in parenthesis by a 3-, 4- or 5 character code consisting of a first letter designating the amino acid residue in the native enzyme, a 1-, 2- or 3-digit number indicating the position of that amino acid residue in the native enzyme, and a final letter designating the amino acid residue in that position in the mutated enzyme. The single-letter designations are IUPAC amino acid abbreviations as reported, for example, at *Eur. J. Biochem.* 138:9-37(1984). For example, the designation "Asch(T184I)" indicates that a threonine (T) at amino acid residue position 184 in the wild type *Acinetobacter schindleri* CIP 107287 enzyme has been replaced with an isoleucine (I).

Production of Multiply-Mutated 3-Ketoacyl-CoA Synthase Genes.

Multi-mutated genes are prepared from wild-type or mutated (parent) 3-ketoacyl-CoA synthase genes using error-prone PCR as the mutagenic method. Error-prone PCR of the 3-ketoacyl-CoA synthase gene is carried out using primers having SEQ ID NO. 94 and SEQ ID NO. 95 and EconoTaq DNA polymerase (Lucigen) with the thermocyling program: 94° C. 2 min, 30×[94° C. 20 s, 55° C. 20 s, 72° C. 72 s], 72° C. 10 min, 4° C. hold. In addition, error-prone PCR reactions contain 50, 100, 150 or 200 M MnCl$_2$. PCR fragments are purified with the DNA Clean and Concentrator kit (Zymo Research), digested with DpnI at 37° C. for 1 h, and purified again. The plasmid and insert are assembled using 2×HiFi Assembly Master Mix, a two-fold molar excess of insert to plasmid and incubation at 50° C. for 1 h.

The amino acid sequences of the gene produced by multiply-mutated genes are designated by a shorthand as described above, with the mutations listed sequentially. For example, "Asch(T184I,S328V)" indicates that a threonine (T) at amino acid residue position 184 in the wild type *Acinetobacter schindleri* CIP 107287 enzyme has been replaced with an isoleucine (I) and a serine at position 328 has been replaced with valine.

Production of Mutant *E. coli* Strains

Mutant *E. coli* strains are prepared using standard electroporation methods. In each case, the host strain is transformed with a "Type 1" plasmid and a "Type 2" plasmid as described below.

Type 1 plasmids are pACYC plasmids containing the p15a origin of replication and chloramphenicol resistance marker. The Type 1 plasmids used in the following examples are:

Type 1A: this plasmid includes a mutated *Streptomyces* sp. nphT7 gene encoding for a 3-ketoacyl-CoA synthase having H100L, I147S, F217V and S323A mutations (the "LSVA" NphT7 mutant, SEQ ID NO. 82), an *E. coli* bifunctional 3-hydroxyacyl-CoA dehydrogenase/dehydratase (fadB) gene and a *T. denticola* enoyl-CoA (ter) gene cassette, all under a native *E. coli* pstsIH promoter and a native *E. coli* terminator. This plasmid also contains a *Hahella chejuensis* ester synthase gene fused to a DNA sequence encoding a protein fragment containing 6 histidine residues and a protease recognition site under an *E. coli* phoE promoter, and an ACC (acetyl-CoA carboxylase) cassette including fused *E. coli* accA and accD genes with a *E. coli* tpiA promoter and a cassette including the *E. coli* accB and *E. coli* accC genes under an *E. coli* rpiA promoter.

Type 1B: this plasmid includes a mutated *Streptomyces* sp. gene encoding for an nphT7 enzyme having I147S and F217V modifications (the "SV" NphT7 mutant, SEQ ID NO. 96) and a *T. denticola* enoyl-CoA (ter) gene cassette, under a native *E. coli* psts1H promoter and a native *E. coli* terminator. The plasmid further contains an *E. coli* bifunctional 3-hydroxyacyl-CoA dehydrogenase/dehydratase (fadB) gene under a native *E. coli* psts1H promoter; and a *Hahella chejuensis* ester synthase gene fused to a DNA sequence encoding a protein fragment containing 6 histidine residues and a protease recognition site under an *E. coli* phoE promoter.

Plasmid type 2A includes a ColE1 origin of replication, a kanamycin resistance marker and the 3-ketoacyl-CoA synthase gene to be evaluated (fused to a DNA sequence that encodes an N-terminal protein fragment containing 6 histidine residues and a protease recognition site unless indicated otherwise) under an *E. coli* promoter and an *E. coli* terminator. The *E. coli* promoter is either the promoter for the native pstS gene (Ppsts1H promoter) or that for the native phoE gene (PphoE promoter), the latter of which is a low phosphate inducible type. The 3-ketoacyl-CoA synthase and the promoter for the 3-ketoacyl-CoA synthase gene are as indicated in the specific examples below.

Plasmid 2B includes a ColE1 origin of replication, a kanamycin resistance marker and the 3-ketoacyl-CoA synthase gene to be evaluated (in some cases without the His-tag) under the Ppsts1H (SEQ ID NO. 118) or PphoE promoter (SEQ ID NO. 117) and an *E. coli* terminator. The 3-ketoacyl-CoA synthase and the promoter for its gene are as indicated in the specific examples below.

Small-Scale Fermentation Method

A culture of synthetic medium containing salts, glucose, NH$_4$Cl, and supplemented with vitamins, yeast extract, 35 µg/ml kanamycin and 20 µg/ml chloramphenicol is inoculated with the strain to be tested and grown overnight at 30° C. The $OD_{600}$ of a 1:10 dilution of this culture is determined, and a volume of the original culture corresponding to 8 OD units is centrifuged and the supernatant discarded. The pelleted cells are resuspended thoroughly in 4 mL fresh medium containing, 30 g/L glucose, 0.158 mM phosphate (low phosphate medium), 1% (V/V) methanol (to produce fatty acid methyl esters) or ethanol (to produce fatty acid ethyl esters), chloramphenicol, and kanamycin as above, and 1-ml aliquots dispensed into triplicate 16-mm glass tubes containing 64 μL of heptadecane or methyl tetradecanoate. This represents a limited phosphate medium that promotes the activity of a low phosphate inducible promoter such as the E. coli PphoE promoter (SEQ ID NO. 117). The tubes are incubated at 30° C., 250 rpm for 4 hours. The incubation temperature is then raised to 37° C. and incubation is continued for a further 20 hours. The entire culture is extracted with methyl tert-butyl ether and the extract analyzed for fatty acid esters by gas chromatography.

Small-Scale Fermentation Method Used for Examples 80-116

A culture of synthetic medium containing salts, glucose, $NH_4Cl$, and supplemented with vitamins, yeast extract, 35 μg/ml kanamycin and 20 μg/ml chloramphenicol is inoculated with the strain to be tested and grown overnight at 32° C. The $OD_{600}$ of a 1:10 dilution of this culture is determined in order to inoculate a Seed 2 flask to a final $OD_{600}$ of 0.3. Seed 2 flasks contain 25-30 ml synthetic medium containing salts, glucose, $NH_4Cl$, and supplemented with vitamins, yeast extract, 35 g/ml kanamycin and 20 μg/ml chloramphenicol, 0-2% methanol. Seed 2 flasks are incubated at 32° C. for 6-7 hours.

The $OD_{600}$ of a 1:10 dilution of this culture is determined in order to inoculate a production flask to a final $OD_{600}$ of 0.01-0.025. Production flasks contain 25 ml synthetic medium containing salts, glucose, $NH_4Cl$, and supplemented with vitamins, yeast extract, 35 μg/ml kanamycin and 20 μg/ml chloramphenicol, 1.25-2.5 mM phosphate, 0-2% methanol, 3-6 g/l glucose, 15-40 g/l glycerol. This represents a limited phosphate medium that promotes the activity of a low phosphate inducible promoter such as the E. coli PphoE promoter (SEQ ID NO. 117). Production flasks are incubated at 32° C. When phosphate is depleted the following additions are made: 2 ml methyl myristate, 1 ml 12.5% tween 80, 1-1.25 ml 50% glycerol. Methanol (0-0.5 ml) is added at the beginning of the production assay or right after phosphate depletion. Additional methanol can be added after phosphate depletion to compensate for methanol evaporation. Flasks are incubated at 35° C. for a further 24 hours. Samples at 24 hours are taken and extracted with 0.1% HCL in MTBE (Methyl tert butyl ether) and the extracts are analyzed for fatty acid esters by gas chromatography.

Small-Scale Fermentation Method Used for Examples 117-148

A shallow 96-well plate of synthetic medium containing salts, glucose, $NH_4Cl$, and supplemented with vitamins, yeast extract, 35 μg/ml kanamycin and 20 μg/ml chloramphenicol is inoculated with the strain to be tested and grown overnight at 30° C. The culture from the shallow 96-well plate is used to inoculate a deep well production plate with 2-3 μl per well. Each well of the production plate contains 400 μl synthetic medium containing salts, glucose, $NH_4Cl$, and supplemented with vitamins, 35 μg/ml kanamycin and 20 μg/ml chloramphenicol, 1.25 mM phosphate, 2% methanol, 3 g/l glucose, 30 g/l glycerol. This represents a limited phosphate medium that promotes the activity of a low phosphate inducible promoter such as the E. coli PphoE promoter (SEQ ID NO. 117). Production plates are incubated at 32° C. When phosphate is depleted, 26 μl methyl myristate is added to each well. Plates are incubated at 35° C. for a further 20 hours. Samples at 20 hours are taken and diluted with acetonitrile and analyzed for fatty acid esters by gas chromatography.

Examples 1-15 and Comparative Samples A-C-Asch(T184I) Variants

Mutant E. coli strain Examples 1 and 2 contain a modified Asch gene encoding a 3-ketoacyl-CoA synthase Asch (T184I) (SEQ ID NO. 9). Comparative Samples A and B contain the wild-type gene (encoding for SEQ ID NO. 8). Details of strain construction are as follows:

| Designation | Host Strain | Plasmid 1 Type | NphT7 mutant | Plasmid 2 Type | 3-ketoacyl-CoA synthase Promoter | Mutant |
|---|---|---|---|---|---|---|
| Ex. 1 | 1 | 1B | SV | 2A | PpstsIH | Asch(T184I) |
| Comp. A* | 1 | 1B | SV | 2A | PpstsIH | wt Asch |
| Ex. 2 | 2 | 1A | LSVA | 2A | PphoE | Asch(T184I) |
| Comp. B* | 2 | 1A | LSVA | 2A | PphoE | wt Asch |

*Not an example of this invention.

Each of Examples 1 and 2 and Comparative Samples are cultured to produce fatty acid methyl esters using the small-scale method described above. Total fatty acid methyl ester (FAME) and amounts of C6, C8 and C10 fatty acid esters produced are as indicated in the following table. Selectivities to C8 and C10 fatty acid esters are indicated under the respective "%" columns; these are calculated as the titer of the C8 or C10 fatty acid ester over the total fatty acid ester production. Amounts of higher- and lower-carbon number fatty acid esters are not shown separately, but are included in the total FAME production value indicated.

| Designation | 3-ketoacyl-CoA synthase | Total FAME production (g/L) | C6 production (g/L) | C8 production (g/L) | C8 % | C10 production (g/L) | C10 % |
|---|---|---|---|---|---|---|---|
| Ex. 1 | Asch(T184I) | 1.17 | 0.21 | 0.75 | 64.1 | 0.22 | 18.5 |
| Comp. A* | Wt** Asch | 1.43 | 0.15 | 0.01 | <1 | 1.27 | 88.5 |
| Ex. 2 | Asch(T184I) | 1.21 | 0.35 | 0.68 | 56.2 | 0.14 | 11.4 |
| Comp. B* | Wt** Asch | 2.13 | 0.27 | 0.07 | 3.1 | 1.75 | 82.1 |

*Not an example of this invention.
**"Wt" in this and subsequent tables indicates the wildtype enzyme.

The wildtype Asch enzyme produces about 82% C10 fatty acid methyl esters, with minimal amounts of the C8 esters. By changing the threonine at position 184 to isoleucine, production is shifted from almost exclusively C10 fatty acid esters to mainly C8 fatty acid esters, with some increased selectivity toward C6 fatty acid esters also being seen. The mutant strain Examples 1 and 2 are useful for producing a mixture of fatty acid esters enriched in the C8 esters.

Mutant E. coli strain Examples 3-5 similarly contain a modified Asch gene encoding a mutated 3-ketoacyl-CoA synthase (Asch(T184L), Asch(T184M) or Asch(T184V)). Comparative Sample C again contains the wild-type gene. Details of strain construction are as follows:

| Designation | Host Strain | Plasmid 1 Type | NphT7 mutant | Plasmid 2 Type | 3-ketoacyl-CoA synthase Promoter | Mutant |
|---|---|---|---|---|---|---|
| Ex. 3 | 1 | 1B | SV | 2A | PpstsIH | Asch(T184L) |
| Ex. 4 | 1 | 1B | SV | 2A | PpstsIH | Asch(T184M) |
| Ex. 5 | 1 | 1B | SV | 2A | PpstsIH | Asch(T184V) |
| Comp. C* | 1 | 1B | SV | 2A | PpstsIH | wt Asch |

*Not an example of this invention.

Each of Examples 3-5 and Comparative Sample C are cultivated to produce fatty acid ethyl esters using the small-scale method described above. Total fatty acid ethyl ester (FAEE) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAEE production value indicated.

| Designation | 3-ketoacyl-CoA synthase | Total FAEE production (g/L) | C6 production g/L | C8 production g/L | C8 production % | C10 production g/L | C10 production % |
|---|---|---|---|---|---|---|---|
| Ex. 3 | Asch(T184L) | 0.88 | 0.30 | 0.22 | 24.4 | 0.37 | 41.6 |
| Ex. 4 | Asch(T184M) | 0.75 | 0.51 | 0.23 | 30.1 | 0.01 | 1.7 |
| Ex. 5 | Asch(T184V) | 1.05 | 0.19 | 0.51 | 48.2 | 0.36 | 33.9 |
| Comp. C | wt Asch | 1.22 | 0.13 | 0.01 | 0.7 | 1.09 | 88.7 |

*Not an example of this invention.

As seen above with Comparative Samples A and B, the wildtype Asch enzyme leads to mainly C10 fatty acid ester production. The T184L, T184M and T184V variations all shift production from C10 fatty acid esters to mainly C6 and C8 fatty acid esters. The T184M variation in Example 4 reduces C10 fatty acid ester production to less than 2%. Selectivity to C8 fatty acid esters is almost 50% for the T184V variation.

Mutant *E. coli* strains Examples 6-15 similarly contain a mutated Asch gene encoding a mutated 3-ketoacyl-CoA synthase with multiple mutations as indicated in the following table. Details of strain construction are as follows:

| Designation | Host Strain | Plasmid 1 Type | NphT7 mutant | Plasmid 2 Type | 3-ketoacyl-CoA synthase Promoter | Mutant |
|---|---|---|---|---|---|---|
| Ex. 6 | 1 | 1A | LSVA | 2A | PpstsIH | Asch(N152T, T184I) |
| Ex. 7 | 1 | 1A | LSVA | 2A | PpstsIH | Asch(N152L, T184I) |
| Ex. 8 | 1 | 1A | LSVA | 2A | PpstsIH | Asch(N152M, T184I) |
| Ex. 9 | 1 | 1A | LSVA | 2A | PpstsIH | Asch(N152C, T184I) |
| Ex. 10 | 1 | 1A | LSVA | 2A | PpstsIH | Asch(A69V, T184I, S328G) |
| Ex. 11 | 1 | 1A | LSVA | 2A | PpstsIH | Asch(G111C, T184I, S328G) |
| Ex. 12 | 1 | 1A | LSVA | 2A | PpstsIH | Asch(D39V, T184I, S328G) |
| Ex. 13 | 1 | 1A | LSVA | 2A | PpstsIH | Asch(D39V, G111C, T184I, S328G) |
| Ex. 14 | 2 | 1A | LSVA | 2A | PpstsIH | Asch(T184I, V268A, V296A, S328G) |
| Ex. 15 | 2 | 1A | LSVA | 2A | PpstsIH | Asch(T184I, V268A, K278R, S328G) |

Each of Examples 6-15 are cultivated to produce fatty acid methyl esters using the small-scale method described above. Total fatty acid methyl ester (FAME) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAME production value indicated.

| Designation | 3-ketoacyl-CoA synthase | Total FAME production (g/L) | C6 production g/L | C8 production | | C10 production | |
|---|---|---|---|---|---|---|---|
| | | | | g/L | % | g/L | % |
| Ex. 6 | Asch(N152T, T184I) | 0.91 | 0.11 | 0.53 | 58.2 | 0.27 | 29.3 |
| Ex. 7 | Asch(N152L, T184I) | 0.41 | 0.12 | 0.23 | 57.3 | 0.05 | 12.2 |
| Ex. 8 | Asch(N152M, T184I) | 1.01 | 0.12 | 0.57 | 56.3 | 0.33 | 32.2 |
| Ex. 9 | Asch(N152C, T184I) | 0.69 | 0.06 | 0.39 | 56.8 | 0.20 | 28.3 |
| Ex. 10 | Asch(A69V, T184I, S328G) | 0.67 | 0.04 | 0.53 | 79.7 | 0.05 | 7.5 |
| Ex. 11 | Asch(G111C, T184I, S328G) | 0.58 | 0.05 | 0.45 | 78.1 | 0.03 | 5.7 |
| Ex. 12 | Asch(D39V, T184I, S328G) | 0.61 | 0.04 | 0.48 | 79.6 | 0.04 | 7.0 |
| Ex. 13 | Asch(D39V, G111C, T184I, S328G) | 0.60 | 0.08 | 0.44 | 74.3 | 0.03 | 4.7 |
| Ex. 14 | Asch(T184I, V268A, V296A, S328G) | 1.033 | 0.04 | 0.84 | 79.8 | 0.12 | 13.2 |
| Ex. 15 | Asch(T184I, V268A, K278R, S328G) | 1.375 | 0.01 | 0.96 | 67.2 | 0.37 | 29.4 |

As this data shows, the multiply-mutated enzymes that contain the T184 mutations all shift production away from C10 fatty acid esters to mainly C8 fatty acid esters. Mutated enzymes having the S328G variation are especially selective toward C8 fatty acid esters in this evaluation, with selectivities approaching 80%.

Examples 16-18 and Comparative Sample D-Asch-2 Variants

Mutant *E. coli* strain Examples 16-18 contain a modified Asch-2 gene encoding a 3-ketoacyl-CoA synthase (Asch-2 (T184M), Asch-2(T184V) and Asch-2(T184I), SEQ ID NOs. 22-24, respectively). Comparative Sample D contains the wild-type gene (encoding for SEQ ID NO. 86). Details of strain construction are as follows:

| Designation | Host Strain | Plasmid 1 Type | NphT7 mutant | Plasmid 2 Type | 3-ketoacyl-CoA synthase | |
|---|---|---|---|---|---|---|
| | | | | | Promoter | Mutant |
| Comp. D* | Host 1 | 1 A | LSVA | 2A | PpstsIH | wt Asch-2 |

-continued

| Designation | Host Strain | Plasmid 1 Type | NphT7 mutant | Plasmid 2 Type | 3-ketoacyl-CoA synthase | |
|---|---|---|---|---|---|---|
| | | | | | Promoter | Mutant |
| Ex. 16 | Host 1 | 1 A | LSVA | 2A | PpstsIH | Asch-2 (T184M) |
| Ex. 17 | Host 1 | 1 A | LSVA | 2A | PpstsIH | Asch-2 (T184V) |
| Ex. 18 | Host 1 | 1 A | LSVA | 2A | PpstsIH | Asch-2 (T184I) |

Each of Examples 16-18 and Comparative Sample D is cultivated to produce fatty acid methyl esters using the small-scale method described above. Total fatty acid methyl ester (FAME) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAEE production value indicated.

| Designation | 3-ketoacyl-CoA synthase | Total FAME production (g/L) | C6 production g/L | C8 production | | C10 production | |
|---|---|---|---|---|---|---|---|
| | | | | g/L | % | g/L | % |
| Comp. D* | wt Asch-2 | 2.75 | 0.03 | 0 | 0 | 2.66 | 96.7 |
| Ex. 16 | Asch-2 (T184M) | 0.82 | 0.30 | 0.36 | 44.0 | 0.11 | 13.8 |
| Ex. 17 | Asch-2 (T184V) | 1.66 | 0.07 | 0.57 | 34.1 | 0.97 | 58.7 |
| Ex. 18 | Asch-2 (T184I) | 2.29 | 0.05 | 0.72 | 31.2 | 1.47 | 64.2 |

*Not an example of this invention.

The wildtype Asch-2 gene produces C10 fatty acid esters almost exclusively. The T184 variations all shift production from C10 fatty acid esters towards C6 and C8 fatty acid esters. Selectivity to C8 fatty acid esters is increased from zero to about 30-45% with these modifications to the Asch-2 gene.

Examples 19-22 and Comparative Sample E—Alwo Variants

Mutant *E. coli* strain Examples 19-22 contain a modified Alwo gene encoding a mutated 3-ketoacyl-CoA synthase (Alwo(T184L), Alwo(T184M), Alwo(T184V) and Alwo (T184I), SEQ ID NOs. 26-29, respectively). Comparative Sample E contains the 5 wild-type gene (encoding for SEQ ID NO. 88). Details of strain construction are as follows:

| Designation | Host Strain | Plasmid 1 Type | NphT7 mutant | Plasmid 2 Type | 3-ketoacyl-CoA synthase | |
|---|---|---|---|---|---|---|
| | | | | | Promoter | Mutant |
| Comp. E* | 1 | 1B | SV | 2A | PpstsIH | wt Alwo |
| Ex. 19 | 1 | 1B | SV | 2A | PpstsIH | Alwo(T184L) |
| Ex. 20 | 1 | 1B | SV | 2A | PpstsIH | Alwo(T184M) |
| Ex. 21 | 1 | 1B | SV | 2A | PpstsIH | Alwo(T184V) |
| Ex. 22 | 1 | 1B | SV | 2A | PpstsIH | Alwo(T184I) |

Each of Examples 19-22 and Comparative Sample E are cultivated to produce fatty acid ethyl esters using the small-scale method described above. Total fatty acid ethyl ester (FAEE) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAEE production value indicated.

| Designation | 3-ketoacyl-CoA synthase | Total FAEE production (g/L) | C6 production g/L) | C8 production | | C10 production | |
|---|---|---|---|---|---|---|---|
| | | | | g/L | % | g/L | % |
| Comp. E* | wt Alwo | 0.95 | 0.05 | 0.00 | 0 | 0.89 | 93.7 |
| Ex. 19 | Alwo(T184L) | 0.73 | 0.31 | 0.20 | 27.7 | 0.22 | 29.6 |
| Ex. 20 | Alwo(T184M) | 0.69 | 0.46 | 0.22 | 31.2 | 0.01 | 1.42 |
| Ex. 21 | Alwo(T184V) | 1.27 | 0.11 | 0.40 | 31.2 | 0.76 | 60.0 |
| Ex. 22 | Alwo(T184I) | 0.85 | 0.19 | 0.53 | 61.8 | 0.13 | 15.5 |

*Not an example of this invention.

The effect of the T184 variations in the Alwo enzyme is similar to those seen in the Asch and Asch-2 mutations. Whereas the wildtype Alwo enzyme produces over 90% C10 fatty acid esters and no C8 fatty acid esters, the T184L, M, V and I variations all shift production toward C6 and C8 fatty acid esters. The T184M and T184I variations are particularly effective in this regard, with C10 fatty acid ester selectivity being reduced to below 20% in each of those cases and C8 fatty acid ester selectivity exceeding 60% in the T184I case.

Examples 23-26 and Comparative Sample F—Ajoh-2 Variants

Mutant *E. coli* strain Examples 23-26 contain a modified Ajoh-2 gene encoding a 3-ketoacyl-CoA synthase (Ajoh-2 (T184L), Ajoh-2(T184M), Ajoh-2(T184V) and Ajoh-2 (T184I), SEQ ID NOs. 36-39, respectively). Comparative Sample F contains the wild-type gene (encoding for SEQ ID NO. 35). Details of strain construction are as follows:

| Designation | Host Strain | Plasmid 1 Type | NphT7 mutant | Plasmid 2 Type | 3-ketoacyl-CoA synthase | |
|---|---|---|---|---|---|---|
| | | | | | Promoter | Mutant |
| Comp. F* | 1 | 1A | LSVA | 2A | PpstsIH | wt Ajoh-2 |
| Ex. 23 | 1 | 1A | LSVA | 2A | PpstsIH | Ajoh-2 (T184L) |
| Ex. 24 | 1 | 1A | LSVA | 2A | PpstsIH | Ajoh-2 (T184M) |
| Ex. 25 | 1 | 1A | LSVA | 2A | PpstsIH | Ajoh-2 (T184V) |
| Ex. 26 | 1 | 1A | LSVA | 2A | PpstsIH | Ajoh-2 (T184I) |

Each of Examples 23-26 and Comparative Sample F are cultivated to produce fatty acid methyl esters using the small-scale method described above. Total fatty acid methyl ester (FAME) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAEE production value indicated.

| Designation | 3-ketoacyl-CoA synthase | Total FAME production (g/L) | C6 production g/L) | C8 production | | C10 production | |
|---|---|---|---|---|---|---|---|
| | | | | g/L | % | g/L | % |
| Comp. F* | wt Ajoh-2 | 2.65 | 0.09 | 0.00 | 0.0 | 2.50 | 96.0 |
| Ex. 23 | Ajoh-2 (T184L) | 0.90 | 0.10 | 0.17 | 19.3 | 0.57 | 63.9 |
| Ex. 24 | Ajoh-2 (T184M) | 0.60 | 0.28 | 0.23 | 38.4 | 0.04 | 6.6 |
| Ex. 25 | Ajoh-2 (T184V) | 2.38 | 0.15 | 0.59 | 24.9 | 1.58 | 66.3 |
| Ex. 26 | Ajoh-2 (T184I) | 0.97 | 0.12 | 0.39 | 39.9 | 0.42 | 43.4 |

*Not an example of the invention.

The same general pattern is seen with the Ajoh-2 gene modifications. The high selectivity of the wildtype gene to C10 fatty acid ester production is shifted toward C6 and C8 fatty acid ester production. The T184M and T184I variations are particularly effective in this regard. The T184V variation results in a large increase of overall productivity compared to the T184L, M and I variations.

Examples 27-29 and Comparative Sample G—ANIP71 Variants

Mutant *E. coli* strain Examples 27-29 contain a modified ANIP71 gene encoding a 3-ketoacyl-CoA synthase (ANIP71(T184M), ANIP71(T184V) and ANIP71(T184I), SEQ ID NOs. 32, 34 and 31, respectively). Comparative Sample G contains the wild-type gene (encoding for SEQ ID NO. 89). Details of strain construction are as follows:

| Designation | Host Strain | Plasmid 1 Type | NphT7 mutant | Plasmid 2 Type | 3-ketoacyl-CoA synthase | |
|---|---|---|---|---|---|---|
| | | | | | Promoter | Mutant |
| Comp. G* | 1 | 1A | LSVA | 2A | PpstsIH | wt ANIP71 |
| Ex. 27 | 1 | 1A | LSVA | 2A | PpstsIH | ANIP71 (T184M) |
| Ex. 28 | 1 | 1A | LSVA | 2A | PpstsIH | ANIP71 (T184V) |
| Ex. 29 | 1 | 1A | LSVA | 2A | PpstsIH | ANIP71 (T184I) |

Each of Examples 27-29 and Comparative Sample G are cultivated to produce fatty acid methyl esters using the small-scale method described above. Total fatty acid methyl ester (FAME) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAME production value indicated.

| Designation | 3-ketoacyl-CoA synthase | Total FAME production (g/L) | C6 production g/L) | C8 production | | C10 production | |
|---|---|---|---|---|---|---|---|
| | | | | g/L | % | g/L | % |
| Comp. G* | wt ANIP71 | 2.71 | 0.04 | 0 | 0 | 2.61 | 96.5 |
| Ex. 27 | ANIP71 (T184M) | 0.49 | 0.27 | 0.15 | 30.1 | 0.03 | 6.1 |
| Ex. 28 | ANIP71 (T184V) | 2.46 | 0.10 | 0.58 | 23.4 | 1.72 | 70.0 |
| Ex. 29 | ANIP71 (T184I) | 0.21 | 0.04 | 0.10 | 47.8 | 0.03 | 14.2 |

*Not an example of the invention.

As before, the T184 variations all shift production from C10 fatty acid esters towards C8 fatty acid esters, with the T184M and T184I variations being particularly effective. The T184V variation results in a large increase of overall productivity compared with the T184M and T184I variations. The T184I variation exhibits the highest selectivity to C8 fatty acid esters.

Examples 30-31 and Comparative Sample H—Pstu Variants

Mutant *E. coli* strain Examples 30-31 contain a modified Pstu gene encoding a 3-ketoacyl-CoA synthase (Pstu (C186M) and Pstu(C186I), respectively, SEQ ID NO. 40, with position 186 being M and I, respectively). Comparative Sample H contains the wild-type gene (encoding for SEQ ID NO. 90). Details of strain construction are as follows:

| Designation | Host Strain | Plasmid 1 Type | NphT7 mutant | Plasmid 2 Type | 3-ketoacyl-CoA synthase Promoter | Mutant |
|---|---|---|---|---|---|---|
| Comp. H* | 1 | 1A | LSVA | 2A | PpstsIH | wt Pstu |
| Ex. 30 | 1 | 1A | LSVA | 2A | PpstsIH | Pstu (C186M) |
| Ex. 31 | 1 | 1A | LSVA | 2A | PpstsIH | Pstu (C186I) |

Each of Examples 30-31 and Comparative Sample H are cultivated to produce fatty acid methyl esters using the small-scale method described above. Total fatty acid methyl ester (FAME) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAME production value indicated.

| Designation | 3-ketoacyl-CoA synthase | Total FAME production (g/L) | C6 production g/L | C8 production g/L | C8 production % | C10 production g/L | C10 production % |
|---|---|---|---|---|---|---|---|
| Comp. H* | wt Pstu | 2.19 | 0.03 | 0 | 0 | 2.08 | 95.1 |
| Ex. 30 | Pstu (C186M) | 0.53 | 0.22 | 0.24 | 44.5 | 0.03 | 5.3 |
| Ex. 31 | Pstu(C186I) | 0.14 | 0.02 | 0.08 | 54.6 | 0 | 0 |

*Not an example of the invention.

The wildtype Pstu enzyme produces C10 fatty acid esters almost exclusively. The C186M and I variations both shift production towards C6 and C8 fatty acid esters, with selectivity toward C8 fatty acid esters being about 40-60%.

Examples 32-61 and Comparative Sample I—Aagr Variants

Mutant *E. coli* strains Examples 32-61 contain a modified Aagr gene encoding a 3-ketoacyl-CoA synthase, as indicated in the following tables. Comparative Sample I contains the wild-type gene (encoding for SEQ ID NO. 91). Details of strain construction are as follows:

| Designation | Host Strain | Plasmid 1 Type | NphT7 mutant | Plasmid 2 Type | 3-ketoacyl-CoA synthase Promoter | Mutant |
|---|---|---|---|---|---|---|
| Comp. I* | 1 | 1B | SV | 1A | PpstsIH | wt Aagr |
| Ex. 32 | 1 | 1B | SV | 1A | PpstsIH | Aagr(A186I) |
| Ex. 33 | 1 | 1B | SV | 1A | PpstsIH | Aagr(A186M) |
| Ex. 34 | 1 | 1B | SV | 1A | PpstsIH | Aagr(A186L) |
| Ex. 35 | 1 | 1B | SV | 1A | PpstsIH | Aagr(A186T) |
| Ex. 36 | 1 | 1B | SV | 1A | PpstsIH | Aagr(A186C) |
| Ex. 37 | 1 | 1B | SV | 1A | PpstsIH | Aagr(A186V) |
| Ex. 38 | 1 | 1B | SV | 1A | PpstsIH | Aagr(A186Q) |
| Ex. 39 | 1 | 1B | SV | 1A | PpstsIH | Aagr(A186F) |
| Ex. 40 | 1 | 1B | SV | 1A | PpstsIH | Aagr(A186D) |
| Ex. 41 | 1 | 1B | SV | 1A | PpstsIH | Aagr(A186N) |
| Ex. 42 | 1 | 1B | SV | 1A | PpstsIH | Aagr(A186Y) |
| Ex. 43 | 1 | 1B | SV | 1A | PpstsIH | Aagr(A186I, I241D) |

-continued

| Designation | Host Strain | Plasmid 1 Type | NphT7 mutant | Plasmid 2 Type | 3-ketoacyl-CoA synthase Promoter | Mutant |
|---|---|---|---|---|---|---|
| Ex. 44 | 1 | 1B | SV | 1A | PpstsIH | Aagr(A186I, I241E) |
| Ex. 45 | 1 | 1B | SV | 1A | PpstsIH | Aagr(A186I, I241D, H246R) |
| Ex. 46 | 1 | 1B | SV | 1A | PpstsIH | Aagr(A186I, I241E, H246R) |
| Ex. 47 | 1 | IB | SV | IA | PpstsIH | Aagr(A186I, C239N, H246R) |
| Ex. 48 | 1 | 1B | SV | 1A | PpstsIH | Aagr(A186I, C239N, I241F) |
| Ex. 49 | 1 | 1B | SV | 1A | PpstsIH | Aagr(A186I, C239N, I241Y) |
| Ex. 50 | 1 | 1B | SV | 1A | PpstsIH | Aagr(A186I, C239D) |
| Ex. 51 | 1 | 1B | SV | 1A | PpstsIH | Aagr(A186I, I241L) |
| Ex. 52 | 1 | 1B | SV | 1A | PpstsIH | Aagr(A186I, I241F) |
| Ex. 53 | 1 | 1B | SV | 1A | PpstsIH | Aagr(A186I, I241Y) |
| Ex. 54 | 1 | 1B | SV | 1A | PpstsIH | Aagr(A186I, H246R) |
| Ex. 55 | 1 | 1B | SV | 1A | PpstsIH | Aagr(A186I, H246K) |
| Ex. 56 | 1 | 1B | SV | 1A | PpstsIH | Aagr(A186I, C239N) |
| Ex. 57 | 1 | 1B | SV | 1A | PpstsIH | Aagr(A186I, C239Q) |
| Ex. 58 | 1 | 1B | SV | 1A | PpstsIH | Aagr(A186I, I241M) |
| Ex. 59 | 1 | 1B | SV | 1A | PpstsIH | Aagr(A186I, I241D, H246K) |
| Ex. 60 | 1 | 1B | SV | 1A | PpstsIH | Aagr(A186I, I241Y, H246R) |
| Ex. 61 | 1 | 1B | SV | 1A | PpstsIH | Aagr(A186I, I241E, H246K) |

Each of Examples 32, 35-42, 44 and 50-61 and Comparative Sample I are cultivated to produce fatty acid ethyl esters in the small-scale method described above. Total fatty acid ethyl ester (FAEE) and amounts of C8 and C10 fatty acid esters produced are as indicated below in the following table, as are selectivities to C8, C10 and C12 fatty acid esters. Amounts of higher- and lower-carbon number fatty acid esters are not shown separately, but are included in the total FAEE production value indicated. "Small" under the "C12 Production" column means that most FAEE production not specifically accounted for in the table is the C6 ethyl ester, with less than 5% C12 fatty acid esters being produced.

| Designation | 3-ketoacyl-CoA synthase | Total FAEE production (g/L) | C8 production g/L | C8 production % | C10 production g/L | C10 production % | C12 production, % |
|---|---|---|---|---|---|---|---|
| Comp. I* | wt Aagr | 0.84 | 0.01 | 1.2 | 0.57 | 67.9 | 18.0 |
| Ex. 32 | Aagr(A186I) | 1.32 | 0.40 | 22.7 | 0.62 | 47.0 | 0.4 |
| Ex. 35 | Aagr(I186T) | 1.16 | 0.02 | 1.9 | 0.81 | 69.8 | 11.0 |
| Ex. 36 | Aagr(A186C) | 0.96 | 0.01 | 1.5 | 0.64 | 67.0 | 13.4 |
| Ex. 37 | Aagr(A186V) | 1.43 | 0.13 | 8.9 | 1.08 | 75.4 | 1.2 |
| Ex. 38 | Aagr(A186Q) | 0.73 | 0.13 | 18.3 | 0.15 | 21.0 | 0.5 |
| Ex. 39 | Aagr(A186F) | 0.97 | 0.09 | 9.0 | 0 | 0.4 | 0.3 |
| Ex. 40 | Aagr(A186D) | 0.55 | 0.01 | 2.1 | 0.40 | 72.5 | 7.8 |
| Ex. 41 | Aagr(A186N) | 0.99 | 0.02 | 1.7 | 0.66 | 66.7 | 11.5 |
| Ex. 42 | Aagr(A186Y) | 0.62 | 0.07 | 10.8 | 0 | 0 | 0 |
| Ex. 44 | Aagr(A186I, I241E) | 1.08 | 0.22 | 20.7 | 0.60 | 55.5 | Small |
| Ex. 50 | Aagr(A186I, C239D) | 0.20 | 0.05 | 26.1 | 0.02 | 12.4 | Small |
| Ex. 51 | Aagr(A186I, I241L) | 1.27 | 0.28 | 22.3 | 0.62 | 48.5 | Small |
| Ex. 52 | Aagr(A186I, I241F) | 1.27 | 0.24 | 18.6 | 0.67 | 58.1 | Small |
| Ex. 53 | Aagr(A186I, I241Y) | 1.34 | 0.25 | 18.5 | 0.81 | 60.4 | Small |
| Ex. 54 | Aagr(A186I, H246R) | 1.22 | 0.36 | 29.5 | 0.60 | 49.0 | Small |
| Ex. 55 | Aagr(A186I, H246K) | 0.93 | 0.26 | 28.5 | 0.35 | 38.1 | Small |
| Ex. 56 | Aagr(A186I, C239N) | 1.32 | 0.21 | 15.8 | 0.80 | 60.9 | Small |
| Ex. 57 | Aagr(A186I, C239Q) | 0.11 | 0.03 | 28.5 | 0.02 | 14.3 | Small |
| Ex. 58 | Aagr(A186I, I241M) | 1.17 | 0.20 | 17.2 | 0.70 | 60.2 | Small |
| Ex. 59 | Aagr(A186I, I241D, H246K) | 0.36 | 0.13 | 36.7 | 0.10 | 26.1 | Small |
| Ex. 60 | Aagr(A186I, I1241Y, H246R) | 1.18 | 0.33 | 27.6 | 0.68 | 57.2 | Small |
| Ex. 61 | Aagr(A186I, I243E, H246K) | 0.42 | 0.14 | 32.7 | 0.09 | 22.5 | Small |

*Not an example of the invention.

The wildtype Aagr enzyme produces 18% C12 fatty acid esters in this evaluation. The replacement of the wildtype Aagr reduces C12 fatty acid ester production, in most cases in favor of higher selectivity toward C8 and/or C10 fatty acid esters.

Each of Examples 32-34 and 43-49 are cultivated to produce fatty acid methyl esters using the small-scale method described above. Total fatty acid methyl ester (FAME) and amounts of C8 and C10 fatty acid esters produced are as indicated in the following table, as are selectivities to C8, C10 and C12 fatty acid esters. Amounts of higher- and lower-carbon number fatty acid esters are not shown separately, but are included in the total FAME production value indicated. "Small" under the "C12 Production" column means that most FAME production not accounted for in the table is the C6 methyl ester, with less than 5% C12 fatty acid esters being produced.

| Designation | 3-ketoacyl-CoA synthase | Total FAME production (g/L) | C8 production g/L | C8 production % | C10 production g/L | C10 production % | C12 production, % |
|---|---|---|---|---|---|---|---|
| Ex. 32 | Aagr(A186I) | 1.46 | 0.20 | 14.0 | 1.06 | 72.8 | 0.5 |
| Ex. 33 | Aagr(A186M) | 1.07 | 0.26 | 23.9 | 0.1 | 9.33 | Small |
| Ex. 34 | Aagr(A186L) | 0.41 | 0.04 | 9.9 | 0.3 | 73.4 | Small |
| Ex. 43 | Aagr(A186I, I241D) | 0.96 | 0.15 | 15.5 | 0.74 | 77.2 | Small |
| Ex. 44 | Aagr(A186I, I241E) | 0.99 | 0.13 | 12.8 | 0.81 | 81.6 | Small |
| Ex. 45 | Aagr(A186I, I241D, H246R) | 0.74 | 0.18 | 24.5 | 0.51 | 68.8 | Small |
| Ex. 46 | Aagr(A186I, I241E, H246R) | 0.42 | 0.14 | 32.2 | 0.24 | 57.4 | Small |
| Ex. 47 | Aagr(A186I, C239N, H246R) | 0.09 | 0.04 | 48.8 | 0.04 | 41.7 | Small |
| Ex. 48 | Aagr(A186I, C239N, I241F) | 1.04 | 0.9 | 8.5 | 0.90 | 86.5 | Small |
| Ex. 49 | Aagr(A186I, C239N, I241Y) | 1.17 | 0.10 | 8.7 | 1.02 | 86.6 | Small |

As the data in the foregoing two table shows, the wildtype Aagr enzyme produces a significant fraction (18%) of C12 fatty acid esters. The A186I modification, by itself or accompanied by additional modifications, reduces C12 fatty acid ester production in favor of C8 and/or C10 fatty acid esters, and in some cases also in favor of C6 fatty acid esters, both in FAEE and FAME production.

Examples 62-71 and Comparative Samples J and K-Asch Variants

Mutant *E. coli* strains Examples 62-71 contain a modified Asch gene encoding a 3-ketoacyl-CoA synthase as indicated in the following tables. Comparative Samples J and K contain the wild-type gene (encoding for SEQ ID NO. 8). In Examples 62-64 and Comparative Sample J only, the mutant Asch gene is fused to a DNA sequence encoding a protein fragment containing 6 histidine residues and a protease recognition site. Details of strain construction are as follows:

| Designation | Host Strain | Plasmid 1 Type | NphT7 mutant | Plasmid 2 Type | 3-ketoacyl-CoA synthase Promoter | Mutant |
|---|---|---|---|---|---|---|
| Comp. J. | 2 | 1A | LSVA | 2A | PpstsIH | Wt Asch |
| Ex. 62 | 2 | 1A | LSVA | 2A | PpstsIH | Asch(K278R) |
| Ex. 63 | 2 | 1A | LSVA | 2A | PpstsIH | Asch(V296A) |
| Ex. 64 | 2 | 1A | LSVA | 2A | PpstsIH | Asch(K278R, V296A) |

-continued

| Designation | Host Strain | Plasmid 1 Type | NphT7 mutant | Plasmid 2 Type | 3-ketoacyl-CoA synthase Promoter | Mutant |
|---|---|---|---|---|---|---|
| Comp. K. | 2 | 1A | LSVA | 2B | PphoE | Wt Asch |
| Ex. 65 | 2 | 1A | LSVA | 2B | PphoE | Asch(V317A) |
| Ex. 66 | 2 | 1A | LSVA | 2B | PphoE | Asch(K278R, V317A) |
| Ex. 67 | 2 | 1A | LSVA | 2B | PphoE | Asch(V296A, V317A) |
| Ex. 68 | 2 | 1A | LSVA | 2B | PphoE | Asch(M271I) |
| Ex. 69 | 2 | 1A | LSVA | 2B | PphoE | Asch(M271I, V296A) |
| Ex. 70 | 2 | 1A | LSVA | 2B | PphoE | Asch(M178L) |
| Ex. 71 | 2 | 1A | LSVA | 2B | PphoE | Asch(M178L, V296A) |

Each of 62-71 and Comparative Samples J and K are cultivated to produce fatty acid methyl esters using the small-scale method described above. Total fatty acid methyl ester (FAME) and amounts of C6, C8 and C10 fatty acid esters produced are as indicated in the following table. Amounts of higher- and lower-carbon number fatty acid esters are not shown separately, but are included in the total FAME production value indicated.

| Designation | 3-ketoacyl-CoA synthase | Total FAME production (g/L) | C6 production g/L | C8 production | C10 production |
|---|---|---|---|---|---|
| Comp. J | Wt Asch | 2.27 | 0.03 | | 2.19 |
| Ex. 62 | Asch(K278R) | 2.77 | 0.03 | | 2.66 |
| Ex. 63 | Asch(V296A) | 3.08 | 0.04 | | 2.96 |
| Ex. 64 | Asch(K278R, V296A) | 3.06 | 0.05 | | 2.93 |
| Comp. K. | Wt Asch | 4.18 | 0.23 | 0.03 | 3.87 |
| Ex. 65 | Asch(V317A) | 4.66 | 0.29 | 0.04 | 4.27 |
| Ex. 66 | Asch(K278R, V317A) | 4.33 | 0.29 | 0.04 | 3.95 |
| Ex. 67 | Asch(V296A, V317A) | 4.89 | 0.26 | 0.03 | 4.55 |
| Ex. 68 | Asch(M271I) | 4.38 | 0.27 | 0.04 | 4.01 |
| Ex. 69 | Asch(M271I, V296A) | 4.40 | 0.27 | 0.02 | 4.06 |
| Ex. 70 | Asch(M178L) | 4.63 | 0.37 | 0.04 | 4.17 |
| Ex. 71 | Asch(M178L, V296A) | 4.64 | 0.40 | 0.03 | 4.16 |

As this data shows, the K278R, the V296A, the V317A, the M271I and M178L mutations all result in an increase in total productivity of the cell, compared to the wild-type Asch enzyme. Productivity is improved in these examples by as much as 36%. The generally higher productivity of Comp. K and Examples 65-71 as compared to Comp. J and Examples 62-64 is believed to be attributable to the combination of having the 3-ketoacyl synthase under the control of a low phosphate inducible promoter together with the selection of a low phosphate medium.

Examples 72-74-Asch(T184I) Variants

Mutant *E. coli* strains Examples 72-74 similarly contain a mutated Asch gene encoding a mutated 3-ketoacyl-CoA synthase with multiple mutations as indicated in the following table. Details of strain construction are as follows:

| Designation | Host Strain | Plasmid 1 Type | NphT7 mutant | Plasmid 2 Type | 3-ketoacyl-CoA synthase Promoter | Mutant |
|---|---|---|---|---|---|---|
| Ex. 72 | 2 | 1A | LSVA | 2A | PpstsIH | Asch(T184I, V268A, V296A, S328G) |
| Ex. 73 | 2 | 1A | LSVA | 2A | PpstsIH | Asch(T184I, V268A, V296A, V317A, S328G) |
| Ex. 74 | 2 | 1A | LSVA | 2A | PpstsIH | Asch (V30A, T184I, V268A, V296A, V317A, S328G) |

Each of examples 72-74 are cultivated to produce fatty acid methyl esters using the small-scale method described above. Total fatty acid methyl ester (FAME) and amounts of C6, C8 and C10 fatty acid esters produced are as indicated in the following table, as are selectivities to C8 and C10 fatty acid esters. Amounts of higher- and lower-carbon number fatty acid esters are not shown separately, but are included in the total FAME production value indicated.

| Designation | 3-ketoacyl-CoA synthase | Total FAME production (g/L) | C6 production g/L | C8 production g/L | C8 production % | C10 production g/L | C10 production % |
|---|---|---|---|---|---|---|---|
| Ex. 72 | Asch (T184I, V268A, V296A, S328G) | 1.03 | 0.04 | 0.84 | 79.8 | 0.12 | 13.2 |
| Ex. 73 | Asch (T184I, V268A, V296A, V317A, S328G) | 1.51 | 0.00 | 0.93 | 62 | 0.51 | 34 |
| Ex. 74 | Asch (V30A, T184I, V268A, V296A, V317A, S328G) | 1.47 | 0.05 | 1.17 | 80 | 0.19 | 11 |

Examples 75-77

*E. coli* mutants are prepared by transforming *E. coli* strain BW25113 with a "Type 1" plasmid and a "Type 2" plasmid, using electroporation methods described before. Details of strain construction are as follows:

| Example No. | Plasmid 1 Type | NphT7 mutant | Plasmid 2 Type | 3-ketoacyl-CoA synthase Promoter | Mutant |
|---|---|---|---|---|---|
| Ex. 75 | 1B | SV | 2A | PpstsIH | Asch T184I |
| Ex. 76 | 1A | LSVA | 2A | PphoE | Asch T184I |
| Ex. 77 | 1A | LSVA | 2A | PpstsIH | Asch T184I |

All of Examples 75-77 exhibit good selectivities toward C6-C10 fatty acid esters, when evaluated using the small-scale fermentation method.

Example 78

The *Saccharomyces cerevisiae* strain IMX581 (Mans, R., H. M. van Rossum, et al. (2015). CRISPR/Cas9: a molecular tool for simultaneous introduction of multiple genetic modifications in *Saccharomyces cerevisiae*. FEMS Yeast Res 15(2)) has Cas9 nuclease integrated in its chromosome such that it can be used as the host strain for manipulating the genome using CRISPR technology (US20140068797 A1). The guide RNA (gRNA) is expressed from either pMEL or pROS series of plasmids. The genes of the non-native fatty acid and fatty acid ester pathway are integrated in the chromosome of IMX581 using this technology. The gRNA sequences are designed using Yeastriction online tool (Robert Mans, HEarme M. van Rossuni, Melanie Wijsman, Antoon Backx, Niels G A. Kuijpers, Marcel van den Broek, Pascale Daran-Lapujade, Jack T. Pronk, Anorionius J. A. van Maris, Jean-Marc G. Daran (2015) CRISPR/Cas9: a molecular Swiss army knife for simultaneous introduction of multiple genetic modifications in *Saccharomyces cerevisiae*. FEMS Yeast Research 16). The gRNA sequence is introduced into pMEL plasmid using complementary primers that have 50 bp of homology and are PAGE-purified. The primers are dissolved in distilled water to a final concentration of 100 µM, the primers are mixed in 1:1 molar ratio, and the mixture is heated to 95° C. for 5 min and annealed by cooling to room temperature. The primers are mixed with pMEL10 as template and the mixture is amplified using Q5 High Fidelity 2× Master Mix (New England BioLabs (Ipswich, Mass.). The PCR product is digested with DpnI for 30 minutes and the PCR product purified on an agarose gel. The protocol for simultaneous integration and deletion is described in Mans et al (supra). Using the protocol, genes that encode for the proteins listed in the table below are integrated into loci in the *S. cerevisiae* chromosome as listed below. The terminators and promoters that are used to express the genes are also listed in the table.

| Gene | Enzyme Encoded | Target locus | Promoter | Terminator |
|---|---|---|---|---|
| NphT7 | SEQ ID NO. 83 | PDC1 gene | Native PDC1 | Native PDC1 |
| NphT7 (LVSA) variant | SEQ ID NO. 82 | CIT3 gene | Native TDH3 | Native ADH1 |
| Mutant 3-ketoacyl-CoA synthase | SEQ ID NO. 11 | ADH1 gene | Native TEF1 | Native ADH1 |
| 3-ketoacyl-CoA reductase | SEQ ID. NO. 98 | GDH1 gene | Native PGK1 | Native CYC1 |
| 3-hydroxyacyl-CoA reductase | SEQ ID NO. 99 | GAL1 gene | Native GPD1 | Native ADH1 |
| Enoyl-CoA reductase | SEQ ID NO. 84 | GAL10 gene | Native PGK1 | Native CYC1 |
| Ester synthase | SEQ ID NO. 104 | GPD1 gene | Native GPD1 | Native GPD1 |

The engineered yeast is grown in 250 mL shake flasks at 30° C. in 25 mL of synthetic defined medium supplemented with 10 g/L of glucose as carbon source. The flasks are shaken at 200 rpm for 24 h. Fatty acid or fatty acid methyl ester acid is measured in the supernatant.

Example 79

The oleaginous yeast *Yarrowia lipolytica* strain LGAM S(7)1 (Papanikolaou S., and Aggelis G., Bioresour. Technol. 82(1):43-9 (2002)). CRISPR/Cas9: a molecular tool for simultaneous introduction of multiple genetic modifications in *Y. lipolytica*. The host is engineered with Cas9 nuclease integrated in its chromosome such that it can be used as the host strain for manipulating the genome using CRISPR technology (US20140068797 A1). The guide RNA (gRNA) is expressed from either pMEL or pROS series of plasmids. The genes of the non-native fatty acid and fatty acid ester pathway are integrated in the chromosome of *Y. lipolytica* using this technology. The gRNA sequences are designed using Yeastriction online tool (Robert Mans, Harmen M. van Rossum, Melanie Wijsman, Antoon Backx, Niels G. A. Kuijpers, Marcel van den Broek, Pascale Daran-Lapujade, Jack T. Pronk, Antonius J. A. van *Maris*, Jean-Marc C. Daran (2015) CRISPR/Cas9: a molecular Swiss army knife for simultaneous introduction of multiple genetic modifications in *Saccharomyces cerevisiae*. FEMS Yeast Research 16). The gRNA sequence is introduced into pMEL plasmid using complementary primers that have 50 bp of homology and are PAGE-purified. The primers are dissolved in distilled water to a final concentration of 100 µM, the primers are mixed in 1:1 molar ratio, and the mixture is heated to 95° C. for 5 min and annealed by cooling to room temperature. The primers are mixed with pMEL10 as template and the mixture is amplified using Q5 High Fidelity 2× Master Mix (New England BioLabs (Ipswich, Mass.). The PCR product is digested with DpnI for 30 minutes and the PCR product purified on an agarose gel. The protocol for simultaneous integration and deletion is described in Mans et al (supra). Using the protocol, genes that encode for the proteins listed in the table below are integrated into the loci in the *Y. lipolytica* chromosome. Examples of the terminator and promoters that are used to express the genes are also listed in the table.

| Gene | Enzyme Encoded | Target locus | Promoter | Terminator |
|---|---|---|---|---|
| NphT7 | SEQ ID NO. 83 | PDC1 gene | Native PDC1 | Native PDC1 |
| NphT7 (LVSA) variant | SEQ ID NO. 82 | XPR2 gene | Native TDH3 | Native ADH1 |
| Mutant 3-ketoacyl-CoA synthase | SEQ ID NO. 11 | ADH1 gene | Native TEF1 | Native ADH1 |
| 3-ketoacyl-CoA reductase | SEQ ID. NO. 98 | GDH1 gene | NativePGK1 | Native CYC1 |
| 3-hydroxyacyl-CoA reductase | SEQ ID NO. 99 | GAL1 gene | Native GPD1 | Native ADH1 |
| Enoyl-CoA reductase | SEQ ID NO. 84 | GAL10 gene | Native PGK1 | Native CYC1 |
| Ester synthase | SEQ ID NO. 104 | GPD1 gene | Native GPD1 | Native GPD1 |

The engineered yeast is grown in 250 mL shake flasks at 30° C. in 25 mL of synthetic defined media supplemented with 10 g/L of glucose as carbon source. The flasks are shaken at 200 rpm for 24 h. Fatty acid or fatty acid methyl ester acid is measured in the supernatant.

Examples 80-96-Asch(T184I) Variants

The mutant 3-ketoacyl-CoA synthase having SEQ ID NO. 20 is selected as a promising candidate for further improvement through additional mutations. Inventive Control A is produced by introducing mutant 3-ketoacyl-CoA synthase having SEQ ID NO. 20 into *E. coli* host strain 3. This inventive example serves as a basis for comparison for the additional mutant Examples 80-96. Mutant *E. coli* strains Examples 80-96 contain a mutated Asch gene encoding a mutated 3-ketoacyl-CoA synthase having the same mutations as SEQ ID NO. 20 together with one or more additional mutations. All mutations differing from the wild-type 3-ketoacyl-CoA synthase (SEQ ID NO. 8) are indicated in the following table. Details of strain construction are as follows:

| Designation | Host Strain | NphT7 mutant | Promoter | 3-ketoacyl-CoA synthase Mutant |
|---|---|---|---|---|
| Inventive Control A | 3 | LSVA | PphoE | Asch (T184I, V268A, V296A, S328G), SEQ ID NO. 20 |
| Ex. 80 | 3 | LSVA | PphoE | Asch(T184I, V268A, V296A, K313E, S328G, A370T), SEQ ID NO. 121 |
| Ex. 81 | 3 | LSVA | PphoE | Asch(T18A, T184I, V268A, V296A, S328G), SEQ ID NO. 122 |
| Ex. 82 | 3 | LSVA | PphoE | Asch(T184I, V268A, V296A, S328G, S329G), SEQ ID NO. 123 |
| Ex. 83 | 3 | LSVA | PphoE | Asch(I127T, T184I, V268A, V296A, S328G), SEQ ID NO. 124 |
| Ex. 84 | 3 | LSVA | PphoE | Asch(T184I, V268A, K274E, V296A, S328G), SEQ ID NO. 125 |
| Ex 85 | 3 | LSVA | PphoE | Asch(, T184I, N231I, V268A, V296A, ,S328G), SEQ ID NO. 204 |
| Ex. 86 | 3 | LSVA | PphoE | Asch(A38V, M178T, T184I, V268A, V296A, A312D, S328G), SEQ ID NO. 126 |
| Ex. 87 | 3 | LSVA | PphoE | Asch(D116G, T184I, F190Y, L241P, V268A, V296A, S328G), SEQ ID NO. 127 |
| Ex. 88 | 3 | LSVA | PphoE | Asch(I94T, T184I, V268A, V296A, S328G), SEQ ID NO. 128 |
| Ex. 89 | 3 | LSVA | PphoE | Asch(L22M, T184I, V268A, V296A, K313M, S328G), SEQ ID NO. 129 |
| Ex. 90 | 3 | LSVA | PphoE | Asch(T184I, V268A, V296A, K313E, S328G), SEQ ID NO. 130 |
| Ex. 91 | 3 | LSVA | PphoE | Asch(T184I, V268A, V296A, S328G, A370T), SEQ ID NO. 131 |
| Ex. 92 | 3 | LSVA | PphoE | Asch(T18A, T184I, V268A, V296A, K313E, S328G, A370T), SEQ ID NO. 132 |
| Ex. 93 | 3 | LSVA | PphoE | Asch(T184I, V268A, V296A, K313E, S328G, S329G, A370T), SEQ ID NO. 133 |
| Ex. 94 | 3 | LSVA | PphoE | Asch(T184I, F236L, V268A, V296A, K313E, V317A, S328G), SEQ ID NO. 134 |
| Ex. 95 | 3 | LSVA | PphoE | Asch(T184I, F236M, V268A, V296A, V317A, S328G), SEQ ID NO. 135 |
| Ex. 96 | 3 | LSVA | PphoE | Asch(T184I, I232V, V268A, V296A, S328G), SEQ ID NO. 136 |

Each of examples 80-96 are cultivated to produce fatty acid methyl esters using the shake flask method described above. Amounts of C8 and C10 fatty acid esters are measured. The ability of each example to increase production of C8 and/or C10 fatty esters is recorded as indicated. The ability of each example to increase specificity for C8 and/or C10 is recorded as indicated.

| Designation | 3-ketoacyl-CoA synthase | Increase total FAME relative to Inventive Control A | Increase C8 FAME relative to Inventive Control A * | Increase C8 FAME Specificity relative to Inventive Control A ** |
|---|---|---|---|---|
| Ex. 80 | Asch(T184I, V268A, V296A, K313E, S328G, A370T) | + | ++ | — |
| Ex. 81 | Asch(T18A, T184I, V268A, V296A, S328G) | + | ++ | + |
| Ex. 82 | Asch(T184I, V268A, V296A, S328G, S329G) | ++ | ++ | — |
| Ex. 83 | Asch(I127T, T184I, V268A, V296A, S328G) | +++ | +++ | O |
| Ex. 84 | Asch(T184I, V268A, K274E, V296A, S328G) | ++ | ++ | O |
| Ex. 85 | Asch(, T184I, N231I, V268A, V296A, ,S328G) | +++ | ++ | O |
| Ex. 86 | Asch(A38V, M178T, T184I, V268A, V296A, A312D, S328G) | + | + | O |
| Ex. 87 | Asch(D116G, T184I, F190Y, L241P, V268A, V296A, S328G) | + | + | O |
| Ex. 88 | Asch(I94T, T184I, V268A, V296A, S328) | ++ | ++ | + |
| Ex. 89 | Asch(L22M, T184I, V268A, V296A, K313M, S328G) | ++ | ++ | +++ |
| Ex. 90 | Asch(T184I, V268A, V296A, K313E , S328G) | + | + | + |
| Ex. 91 | Asch(T184I, V268A, V296A, S328G, A370T) | ++ | ++ | — |
| Ex. 92 | Asch(T18A, T184I, V268A, V296A, K313E, S328G, A370T) | + | + | — |
| Ex. 93 | Asch(T184I, V268A, V296A, K313E , S328G, S329G, A370T) | + | + | ++ |
| Ex. 94 | Asch(T184I, F236L, V268A, V296A, K313E, V317A, S328G) | + | + | +++ |
| Ex. 95 | Asch(T184I, F236M, V268A, V296A, V317A, S328G) | + | | |
| Ex. 96 | Asch(T184I, I232V, V268A, V296A, S328G) | +++ | +++ | — |

*(+) = Increase over control strain
**(+) = Increase over control strain;
(—) = No change over control strain;
(O) = Decrease over control strain Examples 97-99-Asch(T184I) Variants A mutant 3-ketoacyl-CoA synthase having SEQ ID NO. 20, except that the valines appearing at amino acids 30 and 317 each are replaced with alanine, is selected as a candidate for further improvement through additional mutations. Inventive Control B is produced by introducing this mutant 3-ketoacyl-CoA synthase into E. coli host strain 2. This inventive example serves as a basis for comparison for the additional mutants Examples 97-99. Mutant E. coli strains Examples 97-99 contain a mutated Asch gene encoding a mutated 3-ketoacyl-CoA synthase having the same mutations as that of Inventive Control B together with one or more additional mutations. All mutations differing from the wild-type 3-ketoacyl-CoA synthase (SEQ ID NO. 8) are indicated in the following table. Details of strain construction are as follows:

| | Host | NphT7 | | 3-ketoacyl-CoA synthase |
|---|---|---|---|---|
| Designation | Strain | mutant | Promoter | Mutant |
| Inventive Control B | 2 | LSVA | PpstsIH | Asch(V30A, T184I, V268A, V296A, V317A, S328G) |
| Ex. 97 | 2 | LSVA | PpstsIH | Asch(V30A, T184I, V268A, E282G, V296A, V317A, S328G), SEQ ID NO. 137 |
| Ex. 98 | 2 | LSVA | PpstsIH | Asch(V30A, T184I, V268A, V296A, V317A, D322G, S328G), SEQ ID NO. 138 |
| Ex. 99 | 2 | LSVA | PpstsIH | Asch(V30A, T184I, E210V, V268A, V296A, V317A, S328G), SEQ ID NO. 139 |

Each of examples 97-99 are cultivated to produce fatty acid methyl esters using the shake flask method described above. Amounts of C8 and C10 fatty acid esters are measured. The ability of each example to increase production of C8 and/or C10 fatty esters is recorded as indicated. The ability of each example to increase specificity for C8 and/or C10 is recorded as indicated.

| Designation | 3-ketoacyl-CoA synthase | Increase total FAME relative to Inventive Control B | Increase C8 FAME relative to Inventive Control B* | Increase C8 FAME Specificity relative to Inventive Control B** |
|---|---|---|---|---|
| Ex. 97 | Asch(V30A, T184I, V268A, E282G, V296A, V317A, S328G) | +++ | ++ | O |
| Ex. 98 | Asch(V30A, T184I, V268A, V296A, V317A, D322GS328G) | +++ | +++ | — |
| Ex. 99 | Asch(V30A, T184I, E210V, V268A, V296A, V317A, S328G) | + | + | — |

*(+) = Increase over control strain
**(+) = Increase over control strain;
(—) = No change over control strain;
(O) = Decrease over control strain Examples 100-116-Asch(T184I) Variants A mutant 3-ketoacyl-CoA synthase corresponding to SEQ ID NO. 8 with six specific mutations as indicated in the following table, is selected as a candidate for further improvement through additional mutations. Inventive Control C is produced by introducing this mutant 3-ketoacyl-CoA synthase into *E. coli* host strain 3. This inventive example serves as a basis for comparison for the additional mutants Examples 100-116. Mutant *E. coli* strains Examples 100-116 contain a mutated Asch gene encoding a mutated 3-ketoacyl-CoA synthase having the same mutations as that of Inventive Control C together with one or more additional mutations. All mutations differing from the wild-type 3-ketoacyl-CoA synthase (SEQ ID NO. 8) are indicated in the following table. Details of strain construction are as follows:

| Designation | Host Strain | NphT7 mutant | Promoter | 3-ketoacyl-CoA synthase Mutant |
|---|---|---|---|---|
| Inventive Control C | 3 | LSVA | PpstsIH | Asch (V30A, T184I, V268A, V296A, V317A, V328G) |
| Ex. 100 | 3 | LSVA | PpstsIH | Asch(V30A, T184I, V268A, V296A, E315K, V317A, S328G, H368R), SEQ ID NO. 140 |
| Ex. 101 | 3 | LSVA | PpstsIH | Asch(V30A, A54V, T184I, V268A, V296A, V317A, S328G, H368R), SEQ ID NO. 141 |
| Ex. 102 | 3 | LSVA | PpstsIH | Asch(V30A, T184I, V268A, V296A, I302T, V317A, S328G, H368R), SEQ ID NO. 142 |
| Ex. 103 | 3 | LSVA | PpstsIH | Asch(V30A, A54V, T184I, V268A, V296A, I302T, V317A, S328G, H368R), SEQ ID NO. 143 |
| Ex. 104 | 3 | LSVA | PpstsIH | Asch(V30A, T184I, V268A, M271I, V296A, V317A, S328G, H368R), SEQ ID NO. 144 |
| Ex. 105 | 3 | LSVA | PpstsIH | Asch(V30A, T184I, V268A, V296A, V317A, S328G, A356G, H368R), SEQ ID NO. 145 |
| Ex. 106 | 3 | LSVA | PpstsIH | Asch(V30A, T184I, V268A, V296A, V317A, S328G, A356S, H368R), SEQ ID NO. 146 |
| Ex. 107 | 3 | LSVA | PpstsIH | Asch(V30A, A154G, T184I, V268A, V296A, V317A, S328G, H368R), SEQ ID NO. 147 |
| Ex. 108 | 3 | LSVA | PpstsIH | Asch(V30A, T184I, I232V, V268A, V296A, V317A, S328G, H368R), SEQ ID NO. 148 |

| Designation | Host Strain | NphT7 mutant | Promoter | 3-ketoacyl-CoA synthase Mutant |
|---|---|---|---|---|
| Ex. 109 | 3 | LSVA | PpstsIH | Asch(V30A, A54V, A154G, T184I, V268A, V296A, V317A, S328G, H368R), SEQ ID NO. 149 |
| Ex. 110 | 3 | LSVA | PpstsIH | Asch(V30A, A154G, T184I, V268A, M271I, V296A, I302T, V317A, S328G, H368R), SEQ ID NO. 150 |
| Ex. 111 | 3 | LSVA | PpstsIH | Asch(V30A, A54V, A154G, T184I, V268A, M271I, V296A, I302T, V317A, S328G, H368R), SEQ ID NO. 151 |
| Ex. 112 | 3 | LSVA | PpstsIH | Asch(V30A, A54V, T184I, V268A, M271I, V296A, I302T, V317A, S328G, H368R), SEQ ID NO. 152 |
| Ex. 113 | 3 | LSVA | PpstsIH | Asch(V30A, A54V, T184I, V268A, M271I, V296A, V317A, S328G, H368R), SEQ ID NO. 153 |
| Ex. 114 | 3 | LSVA | PpstsIH | Asch(V30A, T184I, V268A, M271I, V296A, I302T, V317A, S328G, H368R), SEQ ID NO. 154 |
| Ex. 115 | 3 | LSVA | PpstsIH | Asch(V30A, A54V, A154G, T184I, V268A, M271I, V296A, V317A, S328G, H368R), SEQ ID NO. 155 |
| Ex. 116 | 3 | LSVA | PpstsIH | Asch(V30A, A154G, T184I, V268A, M271I, V296A, V317A, S328G, H368R), SEQ ID NO. 156 |

Each of examples 100-116 are cultivated to produce fatty acid methyl esters using the shake flask method described above. Amounts of C8 and C10 fatty acid esters are measured. The ability of each example to increase production of C8 and/or C10 fatty esters is recorded as indicated.

| Designation | 3-ketoacyl-CoA synthase | Increase total FAME relative to Inventive Control C | Increase C8 FAME relative to Inventive Control C * | Increase C8 FAME Specificity relative to Inventive Control C** |
|---|---|---|---|---|
| Ex. 100 | Asch(V30A, T184I, V268A, V296A, E315K, V317A, S328G, H368R) | ++ | + | O |
| Ex. 101 | Asch(V30A, A54V, T184I, V268A, V296A, V317A, S328G, H368R) | ++ | ++ | + |
| Ex. 102 | Asch(V30A, T184I, V268A, V296A, I302T, V317A, S328G, H368R) | + | + | + |
| Ex. 103 | Asch(V30A, A54V, T184I, V268A, V296A, I302TV317A, S328G, H368R) | ++ | ++ | + |
| Ex. 104 | Asch(V30A, T184I, V268A, M271I V296A, V317A, S328G, H368R) | ++ | + | + |
| Ex. 105 | Asch(V30A, T184I, V268A, V296A, V317A, S328G, A356G, H368R) | +++ | +++ | + |
| Ex. 106 | Asch(V30A, T184I, V268A, V296A, V317A, S328G, A356S, H368R) | + | + | + |
| Ex. 107 | Asch(V30A, A154G, T184I, V268A, V296A, V317A, S328G, H368R) | ++ | +++ | + |
| Ex. 108 | Asch(V30A, T184I, I232V, V268A, V296A, V317A, S328G, H368R) | +++ | ++ | + |

| Designation | 3-ketoacyl-CoA synthase | Increase total FAME relative to Ex. 107 | Increase C8 FAME relative to Ex. 107* | Increase C8 FAME Specificity relative to Ex. 107** |
|---|---|---|---|---|
| Ex. 109 | Asch(V30A, A54V, A154G, T184I, V268A, V296A, V317A, S328G, H368R) | + | + | O |
| Ex. 110 | Asch(V30A, A154G, T184I, V268A, M271I, V296A, I302T, V317A, S328G, H368R) | + | + | — |

| Designation | 3-ketoacyl-CoA synthase | Increase total FAME relative to Ex. 104 | Increase C8 FAME relative to Ex. 104* | Increase C8 FAME Specificity relative to Ex. 104** |
|---|---|---|---|---|
| Ex. 111 | Asch(V30A, A54V, A154G, T184I, V268A, M271I, V296A, I302T, V317A, S328G, H368R) | +++ | +++ | O |
| Ex. 112 | Asch(V30A, A54V, T184I, V268A, M271I, V296A, I302T, V317A, S328G, H368R) | +++ | +++ | + |
| Ex. 113 | Asch(V30A, A54V, T184I, V268A, M271I, V296A, V317A, S328G, H368R) | + | + | + |
| Ex. 114 | Asch(V30A, T184I, V268A, M271I, V296A, I302T, V317A, S328G, H368R) | +++ | +++ | + |
| Ex. 115 | Asch(V30A, A54V, A154G, T184I, V268A, M271I, V296A, V317A, S328G, H368R) | + | + | + |
| Ex. 116 | Asch(V30A, A154G, T184I, V268A, M271IV296A, V317A, S328G, H368R) | + | ++ | + |

*(+) = Increase over control strain
**(+) = Increase over control strain;
(—) = No change over control strain;
(O) = Decrease over control strain Examples 117-133-Asch(G51) Variants Mutant *E. coli* strains Examples 117-133 similarly contain a mutated Asch gene encoding a mutated 3-ketoacyl-CoA synthase with multiple mutations as indicated in the following table. Details of strain construction are as follows:

| Designation | Host Strain | NphT7 mutant | Promoter | 3-ketoacyl-CoA synthase Mutant |
|---|---|---|---|---|
| Ex. 117 | 3 | LSVA | PphoE | Asch(G51A, T184I, V268A, V296A, S328G), SEQ ID NO. 172 |
| Ex. 118 | 3 | LSVA | PphoE | Asch(G51C, T184I, V268A, V296A, S328G), SEQ ID NO. 173 |
| Ex. 119 | 3 | LSVA | PphoE | Asch(G51D, T184I, V268A, V296A, S328G), SEQ ID NO. 174 |
| Ex. 120 | 3 | LSVA | PphoE | Asch(G51H, T184I, V268A, V296A, S328G), SEQ ID NO. 175 |
| Ex. 121 | 3 | LSVA | PphoE | Asch(G51I, T184I, V268A, V296A, S328G), SEQ ID NO. 176 |
| Ex. 122 | 3 | LSVA | PphoE | Asch(G51K, T184I, V268A, V296A, S328G), SEQ ID NO. 177 |
| Ex. 123 | 3 | LSVA | PphoE | Asch(G51L, T184I, V268A, V296A, S328G), SEQ ID NO. 178 |
| Ex. 124 | 3 | LSVA | PphoE | Asch(G51M, T184I, V268A, V296A, S328G), SEQ ID NO. 179 |
| Ex. 125 | 3 | LSVA | PphoE | Asch(G51N, T184I, V268A, V296A, S328G), SEQ ID NO. 180 |
| Ex. 126 | 3 | LSVA | PphoE | Asch(G51P, T184I, V268A, V296A, S328G), SEQ ID NO. 181 |
| Ex. 127 | 3 | LSVA | PphoE | Asch(G51Q, T184I, V268A, V296A, S328G), SEQ ID NO. 182 |
| Ex. 128 | 3 | LSVA | PphoE | Asch(G51R, T184I, V268A, V296A, S328G), SEQ ID NO. 183 |
| Ex. 129 | 3 | LSVA | PphoE | Asch(G51S, T184I, V268A, V296A, S328G), SEQ ID NO. 184 |
| Ex. 130 | 3 | LSVA | PphoE | Asch(G51T, T184I, V268A, V296A, S328G), SEQ ID NO. 185 |
| Ex. 131 | 3 | LSVA | PphoE | Asch(G51V, T184I, V268A, V296A, S328G), SEQ ID NO. 186 |
| Ex. 132 | 3 | LSVA | PphoE | Asch(G51W, T184I, V268A, V296A, S328G), SEQ ID NO. 187 |
| Ex. 133 | 3 | LSVA | PphoE | Asch(G51Y, T184I, V268A, V296A, S328G), SEQ ID NO. 188 |

Each of examples 117-133 are cultivated to produce fatty acid methyl esters using the shake flask method described above. Total fatty acid methyl ester (FAME) and amounts of C8 and C10 fatty acid esters produced are as indicated in the following table, as are relative percentages of C8 and C10 fatty acids. Amounts of higher- and lower-carbon number fatty acid esters are not shown separately, but are included in the total FAME production value indicated.

| Designation | 3-ketoacyl-CoA synthase | Total FAME production relative to Inventive Control A | C8 FAME g/L relative to Inventive Control A |
|---|---|---|---|
| Ex. 117 | Asch(G51A, T184I, V268A, V296A, S328G), SEQ ID NO. 172 | + | + |
| Ex. 118 | Asch(G51C, T184I, V268A, V296A, S328G), SEQ ID NO. 173 | + | + |
| Ex. 119 | Asch(G51D, T184I, V268A, V296A, S328G), SEQ ID NO. 174 | +++ | ++ |
| Ex. 120 | Asch(G51H, T184I, V268A, V296A, S328G), SEQ ID NO. 175 | ++ | ++ |
| Ex. 121 | Asch(G51I, T184I, V268A, V296A, S328G), SEQ ID NO. 176 | + | + |
| Ex. 122 | Asch(G51K, T184I, V268A, V296A, S328G), SEQ ID NO. 177 | +++ | +++ |
| Ex. 123 | Asch(G51L, T184I, V268A, V296A, S328G), SEQ ID NO. 178 | +++ | +++ |
| Ex. 124 | Asch(G51M, T184I, V268A, V296A, S328G), SEQ ID NO. 179 | +++ | +++ |
| Ex. 125 | Asch(G51N, T184I, V268A, V296A, S328G), SEQ ID NO. 180 | +++ | +++ |
| Ex. 126 | Asch(G51P, T184I, V268A, V296A, S328G), SEQ ID NO. 181 | +++ | +++ |
| Ex. 127 | Asch(G51Q, T184I, V268A, V296A, S328G), SEQ ID NO. 182 | +++ | +++ |
| Ex. 128 | Asch(G51R, T184I, V268A, V296A, S328G), SEQ ID NO. 183 | + | + |
| Ex. 129 | Asch(G51S, T184I, V268A, V296A, S328G), SEQ ID NO. 184 | ++ | ++ |
| Ex. 130 | Asch(G51T, T184I, V268A, V296A, S328G), SEQ ID NO. 185 | + | ++ |
| Ex. 131 | Asch(G51V, T184I, V268A, V296A, S328G), SEQ ID NO. 186 | + | ++ |
| Ex. 133 | Asch(G51W, T184I, V268A, V296A, S328G), SEQ ID NO. 187 | ++ | ++ |
| Ex. 133 | Asch(G51Y, T184I, V268A, V296A, S328G), SEQ ID NO. 188 | +++ | ++ |

Examples 134-148-Asch(G51) Variants

A mutant 3-ketoacyl-CoA synthase corresponding to SEQ ID NO. 8 with seven specific mutations as indicated in the following table, is selected as a candidate for further improvement through additional mutations. Inventive Control D is produced by introducing this mutant 3-ketoacyl-CoA synthase into *E. coli* host strain 3. This inventive example serves as a basis for comparison for the additional mutants Examples 134-148. Mutant *E. coli* strains Examples 134-148 contain a mutated Asch gene encoding a mutated 3-ketoacyl-CoA synthase having the same mutations as that of Inventive Control D together with one or more additional mutations. All mutations differing from the wild-type 3-ketoacyl-CoA synthase (SEQ ID NO. 8) are indicated in the following table. Details of strain construction are as follows:

| Designation | Host Strain | NphT7 mutant | Promoter | 3-ketoacyl-CoA synthase Mutant |
|---|---|---|---|---|
| Inventive Control D | 3 | LSVA | PpstsIH | Asch (V30A, T184I, V268A, V296A, V317A, S238G, H368R) |
| Ex. 134 | 3 | LSVA | PpstsIH | Asch(V30A, G51C, T184I, V268A, V296A, V317A, S328G, H368R), SEQ ID NO. 189 |
| Ex. 135 | 3 | LSVA | PpstsIH | Asch(V30A, G51D, T184I, V268A, V296A, V317A, S328G, H368R), SEQ ID NO. 190 |
| Ex. 136 | 3 | LSVA | PpstsIH | Asch(V30A, G51E, T184I, V268A, V296A, V317A, S328G, H368R), SEQ ID NO. 191 |
| Ex. 137 | 3 | LSVA | PpstsIH | Asch(V30A, G51F, T184I, V268A, V296A, V317A, S328G, H368R), SEQ ID NO. 192 |
| Ex. 138 | 3 | LSVA | PpstsIH | Asch(V30A, G51H, T184I, V268A, V296A, V317A, S328G, H368R), SEQ ID NO. 193 |
| Ex. 139 | 3 | LSVA | PpstsIH | Asch(V30A, G51I, T184I, V268A, V296A, V317A, S328G, H368R), SEQ ID NO. 194 |
| Ex. 140 | 3 | LSVA | PpstsIH | Asch(V30A, G51K, T184I, V268A, V296A, V317A, S328G, H368R), SEQ ID NO. 195 |

| Designation | Host Strain | NphT7 mutant | Promoter | 3-ketoacyl-CoA synthase Mutant |
|---|---|---|---|---|
| Ex. 141 | 3 | LSVA | PpstsIH | Asch(V30A, G51M, T184I, V268A, V296A, V317A, S328G, H368R), SEQ ID NO. 196 |
| Ex. 142 | 3 | LSVA | PpstsIH | Asch(V30A, G51N, T184I, V268A, V296A, V317A, S328G, H368R), SEQ ID NO. 197 |
| Ex. 143 | 3 | LSVA | PpstsIH | Asch(V30A, G51P, T184I, V268A, V296A, V317A, S328G, H368R), SEQ ID NO. 198 |
| Ex. 144 | 3 | LSVA | PpstsIH | Asch(V30A, G51R, T184I, V268A, V296A, V317A, S328G, H368R), SEQ ID NO. 199 |
| Ex. 145 | 3 | LSVA | PpstsIH | Asch(V30A, G51S, T184I, V268A, V296A, V317A, S328G, H368R), SEQ ID NO. 200 |
| Ex. 146 | 3 | LSVA | PpstsIH | Asch(V30A, G51T, T184I, V268A, V296A, V317A, S328G, H368R), SEQ ID NO. 201 |
| Ex. 147 | 3 | LSVA | PpstsIH | Asch(V30A, G51W, T184I, V268A, V296A, V317A, S328G, H368R), SEQ ID NO. 202 |
| Ex. 148 | 3 | LSVA | PpstsIH | Asch(V30A, G51Y, T184I, V268A, V296A, V317A, S328G, H368R), SEQ ID NO. 203 |

Each of examples 134-148 are cultivated to produce fatty acid methyl esters using the shake flask method described above. Total fatty acid methyl ester (FAME) and amounts of C8 and C10 fatty acid esters produced are as indicated in the following table, as are relative percentages of C8 and C10 fatty acids. Amounts of higher- and lower-carbon number fatty acid esters are not shown separately, but are included in the total FAME production value indicated.

| Designation | 3-ketoacyl-CoA synthase | Total FAME production relative to Inventive Control D | C8 FAME g/L relative to Inventive Control D |
|---|---|---|---|
| Ex. 134 | Asch(V30A, G51C, T184I, V268A, V296A, V317A, S328G, H368R), SEQ ID NO. 189 | + | +++ |
| Ex. 135 | Asch(V30A, G51D, T184I, V268A, V296A, V317A, S328G, H368R), SEQ ID NO. 190 | +++ | ++ |
| Ex. 136 | Asch(V30A, G51E, T184I, V268A, V296A, V317A, S328G, H368R), SEQ ID NO. 191 | +++ | ++ |
| Ex. 137 | Asch(V30A, G51F, T184I, V268A, V296A, V317A, S328G, H368R), SEQ ID NO. 192 | +++ | ++ |
| Ex. 138 | Asch(V30A, G51H, T184I, V268A, V296A, V317A, S328G, H368R), SEQ ID NO. 193 | + | + |
| Ex. 139 | Asch(V30A, G51I, T184I, V268A, V296A, V317A, S328G, H368R), SEQ ID NO. 194 | + | +++ |
| Ex. 140 | Asch(V30A, G51K, T184I, V268A, V296A, V317A, S328G, H368R), SEQ ID NO. 195 | +++ | +++ |
| Ex. 141 | Asch(V30A, G51M, T184I, V268A, V296A, V317A, S328G, H368R), SEQ ID NO. 196 | ++ | ++ |
| Ex. 142 | Asch(V30A, G51N, T184I, V268A, V296A, V317A, S328G, H368R), SEQ ID NO. 197 | +++ | ++ |
| Ex. 143 | Asch(V30A, G51P, T184I, V268A, V296A, V317A, S328G, H368R), SEQ ID NO. 198 | + | + |
| Ex. 144 | Asch(V30A, G51R, T184I, V268A, V296A, V317A, S328G, H368R), SEQ ID NO. 199 | + | + |
| Ex. 145 | Asch(V30A, G51S, T184I, V268A, V296A, V317A, S328G, H368R), SEQ ID NO. 200 | + | ++ |
| Ex. 146 | Asch(V30A, G51T, T184I, V268A, V296A, V317A, S328G, H368R), SEQ ID NO. 201 | + | +++ |
| Ex. 147 | Asch(V30A, G51W, T184I, V268A, V296A, V317A, S328G, H368R), SEQ ID NO. 202 | ++ | ++ |
| Ex. 148 | Asch(V30A, G51Y, T184I, V268A, V296A, V317A, S328G, H368R), SEQ ID NO. 203 | + | + |

EMBODIMENTS

1. A 3-ketoacyl-CoA synthase having an amino acid sequence characterized in including at least one of a) a sub-sequence at least 80% identical to SEQ ID NO. 1, provided that an amino acid residue that aligns to amino acid residue 8 of SEQ ID NO. 1 is leucine, valine, isoleucine or methionine and amino acid residue 2 is leucine or methionine; b) a sub-sequence at least 80% identical to SEQ ID NO. 2, provided that an amino acid residue that aligns to amino acid residue 6 of SEQ ID NO. 2 is isoleucine or methionine and c) a sub-sequence at least 80% identical to SEQ ID NO. 3, provided that an amino acid residue that aligns with amino acid residue 6 of SEQ ID NO. 3 is isoleucine, methionine, threonine, cysteine, valine, glutamine, phenylalanine, aspartic acid, asparagine or tyrosine.

2. A 3-ketoacyl-CoA synthase having an amino acid sequence characterized in including at least one of a) SEQ ID NO. 1, b) SEQ ID NO. 2 and c) SEQ ID NO. 3.

3. The 3-ketoacyl-CoA synthase of embodiment 2 wherein the amino acid sequence includes SEQ ID NO. 1.

4. The 3-ketoacyl-CoA synthase of any of embodiments 1-3 wherein the amino acid sequence further includes at least one of a) SEQ ID NO. 4 or SEQ ID NO. 161, b) SEQ ID NO. 5 and c) SEQ ID NO. 6 or SEQ ID NO. 162.

5. The 3-ketoacyl-CoA synthase of embodiment 4 wherein the amino acid sequence includes SEQ ID NO. 44.

6. The 3-ketoacyl-CoA synthase of embodiment 5 wherein the amino acid sequence includes a sub-sequence at least 85% identical to SEQ ID NO. 45, provided that an amino acid residue of the 3-ketoacyl-CoA synthase that aligns to amino acid residue 35 of SEQ ID NO. 5 is leucine, valine, isoleucine or methionine.

7. The 3-ketoacyl-CoA synthase of embodiment 5 wherein the amino acid sequence includes SEQ ID NO. 45.

8. The 3-ketoacyl-CoA synthase of any of embodiments 4-7 wherein the amino acid sequence includes SEQ ID NO. 4 or SEQ ID NO. 161, SEQ ID NO. 5 and SEQ ID NO. 6 or SEQ ID NO. 162.

9. The 3-ketoacyl-CoA synthase of embodiment 7 wherein the amino acid sequence further includes SEQ ID NO. 46.

10. The 3-ketoacyl-CoA synthase of embodiment 8 wherein the amino acid sequence includes SEQ ID NO. 47.

11. The 3-ketoacyl-CoA synthase of any of embodiments 1-10 wherein the amino acid sequence includes SEQ ID NO. 48.

12. The 3-ketoacyl-CoA synthase of embodiment 3 wherein the amino acid sequence is at least 80% identical to SEQ ID NO. 49.

13. The 3-ketoacyl-CoA synthase of embodiment 3 wherein the amino acid sequence has SEQ ID NO. 49.

14. The 3-ketoacyl-CoA synthase of any of embodiments 1-13 wherein the amino acid sequence is at least 50% identical to SEQ ID NO. 8.

15. The 3-ketoacyl-CoA synthase of embodiment 14 wherein the amino acid sequence is at least 80% identical to SEQ ID NO. 8.

16. A 3-ketoacyl-CoA synthase having an amino acid sequence is selected from the group consisting of SEQ ID NO. 9, SEQ ID NO. 10, SEQ ID NO. 11, SEQ ID NO. 12, SEQ ID NO. 13, SEQ ID NO. 14, SEQ ID NO. 15, SEQ ID NO. 16, SEQ ID NO. 17, SEQ ID NO. 18, SEQ ID NO. 19, SEQ ID NO. 20, SEQ ID NO. 21, SEQ ID NO. 22, SEQ ID NO. 23, SEQ ID NO. 24, SEQ ID NO. 25, SEQ ID NO. 26, SEQ ID NO. 27, SEQ ID NO. 28, SEQ ID NO. 29, SEQ ID NO. 30, SEQ ID NO. 31, SEQ ID NO. 32, SEQ ID NO. 33, SEQ ID NO. 34, SEQ ID NO. 36, SEQ ID NO. 37, SEQ ID NO. 38, SEQ ID NO. 39, SEQ ID NO. 92, SEQ ID NO. 93, any one of SEQ ID NOs 121-157 or any one of SEQ ID NOs. 172-204.

17. The 3-ketoacyl-CoA synthase of embodiment 2 wherein the amino acid sequence includes SEQ ID NO. 2.

18. The 3-ketoacyl-CoA synthase of embodiment 17 wherein the amino acid sequence further includes at least one of a) SEQ ID NO. 4 or SEQ ID NO. 161, b) SEQ ID NO. 5 and c) SEQ ID NO. 6 or SEQ ID NO. 162.

19. The 3-ketoacyl-CoA synthase of embodiment 18 wherein the amino acid sequence is at least 50% identical to SEQ ID NO. 40.

20. The 3-ketoacyl-CoA synthase of embodiment 19 wherein the amino acid sequence is at least 80% identical to SEQ ID NO. 40.

21. The 3-ketoacyl-CoA synthase of embodiment 18 which has SEQ. ID NO. 40.

22. The 3-ketoacyl-CoA synthase of embodiment 2 wherein the amino acid sequence includes SEQ ID NO. 3.

23. The 3-ketoacyl-CoA synthase of embodiment 22 wherein the amino acid sequence further includes a) SEQ ID NO. 4 or SEQ ID NO. 161, b) SEQ ID NO. 5 and c) SEQ ID NO. 6 or SEQ ID NO. 162.

24. The 3-ketoacyl-CoA synthase of embodiment 22 wherein the amino acid sequence includes SEQ ID NO. 41.

25. The 3-ketoacyl-CoA synthase of embodiment 22 wherein the amino acid sequence is at least 50% identical to SEQ ID NO. 42 or 43.

26. The 3-ketoacyl-CoA synthase of embodiment 22 wherein the amino acid sequence at least 80% identical to SEQ ID NO. 42 or 43.

27. The 3-ketoacyl-CoA synthase of embodiment 22 wherein the amino acid sequence is SEQ. ID NO. 42 or 43.

28. A 3-ketoacyl-CoA synthase having an amino acid sequence characterized in including SEQ ID. NO. 50.

29. The 3-ketoacyl-CoA synthase of embodiment 28 wherein the amino acid sequence includes SEQ ID NO. 51.

30. The 3-ketoacyl-CoA synthase of embodiment 28 wherein the amino acid sequence includes SEQ ID NO. 52.

31. The 3-ketoacyl-CoA synthase of embodiment 28 wherein the amino acid sequence includes SEQ ID NO. 53.

32. The 3-ketoacyl-CoA synthase of any of embodiments 23-31 wherein the amino acid sequence further includes SEQ ID NO. 46.

33. The 3-ketoacyl-CoA synthase of embodiment 28 wherein the amino acid sequence includes SEQ ID NO. 54.

34. The 3-ketoacyl-CoA synthase of any of embodiments 28-33 wherein the amino acid sequence further includes SEQ ID NO. 48.

35. The 3-ketoacyl-CoA synthase of embodiment 28 wherein the amino acid sequence includes SEQ ID NO. 55.

36. A 3-ketoacyl-CoA synthase having an amino acid sequence characterized in including SEQ ID. NO. 56.

37. The 3-ketoacyl-CoA synthase of embodiment 36 wherein the amino acid sequence includes SEQ ID NO. 57.

38. The 3-ketoacyl-CoA synthase of embodiment 36 or 37 wherein the amino acid sequence further includes SEQ ID NO. 51.

39. The 3-ketoacyl-CoA synthase of embodiment 36 or 37 wherein the amino acid sequence further includes SEQ ID NO. 52.

40. The 3-ketoacyl-CoA synthase of embodiment 36 or 37 wherein the amino acid sequence further includes SEQ ID NO. 53.

41. The 3-ketoacyl-CoA synthase of embodiment 36 wherein the amino acid sequence includes SEQ ID NO. 58.

42. The 3-ketoacyl-CoA synthase of any of embodiments 36-41 wherein the amino acid sequence further includes SEQ ID NO. 48.

43. The 3-ketoacyl-CoA synthase of embodiment 36 wherein the amino acid sequence includes SEQ ID NO. 59.

44. A 3-ketoacyl-CoA synthase having an amino acid sequence characterized in including SEQ ID. NO. 60.

45. The 3-ketoacyl-CoA synthase of embodiment 44 wherein the amino acid sequence includes SEQ ID. NO. 61.

46. The 3-ketoacyl-CoA synthase of embodiment 44 wherein the amino acid sequence includes SEQ ID. NO. 62.

47. The 3-ketoacyl-CoA synthase of embodiment 44 wherein the amino acid sequence includes SEQ ID. NO. 63.

48. The 3-ketoacyl-CoA synthase of any of embodiments 44-46 wherein the amino acid includes SEQ ID. NO. 46.

49. The 3-ketoacyl-CoA synthase of any of embodiments 44-48 wherein the amino acid sequence includes SEQ ID. NO. 48.

50. The 3-ketoacyl-CoA synthase of embodiment 44 wherein the amino acid sequence includes SEQ ID. NO. 64.

51. A 3-ketoacyl-CoA synthase having an acid sequence characterized in including SEQ ID. NO. 65.

52. The 3-ketoacyl-CoA synthase of embodiment 51 wherein the amino acid sequence includes SEQ ID. NO. 51.

53. The 3-ketoacyl-CoA synthase of any of embodiments 51 or 52 wherein the amino acid sequence includes SEQ ID. NO. 66.
54. The 3-ketoacyl-CoA synthase of any of embodiments 51-53 wherein the amino acid sequence includes SEQ ID. NO. 48.
55. The 3-ketoacyl-CoA synthase of any of embodiments 51-54 wherein the amino acid sequence includes at least one of a) SEQ ID. NO. 4 or SEQ ID NO. 161 and b) SEQ ID NO. 5.
56. The 3-ketoacyl-CoA synthase of any of embodiments 51-55 wherein the amino acid sequence includes SEQ ID. NO. 53.
57. The 3-ketoacyl-CoA synthase of embodiment 51 wherein the amino acid sequence includes SEQ ID. NO. 67.
58. The 3-ketoacyl-CoA synthase of embodiment 51 wherein the amino acid sequence includes SEQ ID. NO. 68.
59. A 3-ketoacyl-CoA synthase comprising a heterologous nucleic acid sequence encoding a 3-ketoacyl-CoA synthase having an amino sequence characterized in including SEQ ID. NO. 69.
60. The 3-ketoacyl-CoA synthase of embodiment 59 wherein the amino acid sequence further includes SEQ ID. NO. 51.
61. The 3-ketoacyl-CoA synthase of embodiment 59 or 60 wherein the amino acid sequence includes SEQ ID NO. 52.
62. The 3-ketoacyl-CoA synthase of embodiment 59 or 69 wherein the amino acid sequence includes SEQ ID NO. 53.
63. The 3-ketoacyl-CoA synthase of any of embodiments 56-62 wherein the amino acid sequence includes at least one of a) SEQ ID NO. 5 and b) SEQ ID NO. 6 or SEQ ID NO. 162.
64. The 3-ketoacyl-CoA synthase of any of embodiments 59-63 wherein the amino acid sequence includes SEQ ID NO. 46.
65. The 3-ketoacyl-CoA synthase of embodiment 59 or 60 wherein the amino acid sequence includes SEQ ID NO. 70.
66. The 3-ketoacyl-CoA synthase of any of embodiments 59-65 wherein the amino acid sequence includes SEQ ID NO. 48.
67. The 3-ketoacyl-CoA synthase of embodiment 59 wherein the amino acid sequence includes ID NO. 71.
68. A ketoacyl-CoA synthase having SEQ ID NO. 110 or being at least 80% identical to SEQ ID NO. 110, comprising in each case at least one of features i)-xiii):
  i) an amino acid residue of the ketoacyl-CoA synthase that aligns with amino acid residue 30 of SEQ ID NO. 110 is alanine;
  ii) an amino acid residue of the ketoacyl-CoA synthase that aligns with amino acid residue 39 of SEQ ID NO. 110 is valine;
  iii) an amino acid residue of the ketoacyl-CoA synthase that aligns with amino acid residue 69 of SEQ ID NO. 110 is valine;
  iv) an amino acid residue of the ketoacyl-CoA synthase that aligns with amino acid residue 111 of SEQ ID NO. 110 is cysteine;
  v) an amino acid residue of the ketoacyl-CoA synthase that aligns with amino acid residue 152 of SEQ ID NO. 110 is cysteine, leucine, methionine or threonine;
  vi) an amino acid residue of the ketoacyl-CoA synthase that aligns with amino acid residue 178 of SEQ ID NO. 110 is leucine;
  vii) an amino acid residue of the ketoacyl-CoA synthase that aligns with amino acid residue 184 of SEQ ID NO. 110 is isoleucine, leucine, methionine or valine;
  viii) an amino acid residue of the ketoacyl-CoA synthase that aligns with amino acid residue 268 of SEQ ID NO. 110 is alanine;
  ix) an amino acid residue of the ketoacyl-CoA synthase that aligns with amino acid residue 271 of SEQ ID NO. 110 is isoleucine;
  x) an amino acid residue of the ketoacyl-CoA synthase that aligns with amino acid residue 278 of SEQ ID NO. 110 is arginine;
  xi) an amino acid residue of the ketoacyl-CoA synthase that aligns with amino acid residue 296 of SEQ ID NO. 110 is alanine;
  xii) an amino acid residue of the ketoacyl-CoA synthase that aligns with amino acid residue 317 of SEQ ID NO. 110 is alanine;
  xiii) an amino acid residue of the ketoacyl-CoA synthase that aligns with amino acid residue 328 of SEQ ID NO. 110 is glycine.
69. A ketoacyl-CoA synthase having SEQ ID NO. 119 or being at least 80% identical to SEQ ID NO. 119, comprising in each case at least one of features i) to xliii):
  i) an amino acid residue of the ketoacyl-CoA synthase that aligns with amino acid residue 18 of SEQ ID NO. 119 is alanine;
  ii) an amino acid residue of the ketoacyl-CoA synthase that aligns with amino acid residue 22 of SEQ ID NO. 119 is methionine;
  iii) an amino acid residue of the ketoacyl-CoA synthase that aligns with amino acid residue 30 of SEQ ID NO. 119 is alanine;
  iv) an amino acid residue of the ketoacyl-CoA synthase that aligns with amino acid residue 38 of SEQ ID NO. 119 is valine;
  v) an amino acid residue of the ketoacyl-CoA synthase that aligns with amino acid residue 39 of SEQ ID NO. 119 is valine;
  vi) an amino acid residue of the ketoacyl-CoA synthase that aligns with amino acid residue 51 of SEQ ID NO. 119 is alanine, cysteine, aspartic acid, histidine, isoleucine, lysine, leucine, methionine, asparagine, proline, glutamine, arginine, serine, threonine, valine, tryptophan or tyrosine;
  vii) an amino acid residue of the ketoacyl-CoA synthase that aligns with amino acid residue 54 of SEQ ID NO. 119 is valine;
  viii) an amino acid residue of the ketoacyl-CoA synthase that aligns with amino acid residue 69 of SEQ ID NO. 119 is valine;
  ix) an amino acid residue of the ketoacyl-CoA synthase that aligns with amino acid residue 83 of SEQ ID NO. 119 is asparagine;
  x) an amino acid residue of the ketoacyl-CoA synthase that aligns with amino acid residue 94 of SEQ ID NO. 119 is threonine, leucine, glutamic acid, or alanine;
  xi) an amino acid residue of the ketoacyl-CoA synthase that aligns with amino acid residue 111 of SEQ ID NO. 119 is cysteine;
  xii) an amino acid residue of the ketoacyl-CoA synthase that aligns with amino acid residue 116 of SEQ ID NO. 119 is glycine;
  xiii) an amino acid residue of the ketoacyl-CoA synthase that aligns with amino acid residue 127 of SEQ ID NO. 119 is a threonine;
  xiv) an amino acid residue of the ketoacyl-CoA synthase that aligns with amino acid residue 130 of SEQ ID NO. 119 is glycine;

xv) an amino acid residue of the ketoacyl-CoA synthase that aligns with amino acid residue 152 of SEQ ID NO. 119 is cysteine, leucine, methionine or threonine;

xvi) an amino acid residue of the ketoacyl-CoA synthase that aligns with amino acid residue 154 of SEQ ID NO. 119 is glycine;

xvii) an amino acid residue of the ketoacyl-CoA synthase that aligns with amino acid residue 178 of SEQ ID NO. 119 is leucine or threonine;

xviii) an amino acid residue of the ketoacyl-CoA synthase that aligns with amino acid residue 190 of SEQ ID NO. 119 is phenylalanine or tyrosine;

xix) an amino acid residue of the ketoacyl-CoA synthase that aligns with amino acid residue 210 of SEQ ID NO. 119 is valine;

xx) an amino acid residue of the ketoacyl-CoA synthase that aligns with amino acid residue 223 of SEQ ID NO. 119 is histidine;

xxi) an amino acid residue of the ketoacyl-CoA synthase that aligns with amino acid residue 231 of SEQ ID NO. 119 is isoleucine;

xxii) an amino acid residue of the ketoacyl-CoA synthase that aligns with amino acid residue 232 of SEQ ID NO. 119 is valine;

xxiii) an amino acid residue of the ketoacyl-CoA synthase that aligns with amino acid residue 236 of SEQ ID NO. 119 is leucine or methionine;

xxiv) an amino acid residue of the ketoacyl-CoA synthase that aligns with amino acid residue 241 of SEQ ID NO. 119 is proline;

xxv) an amino acid residue of the ketoacyl-CoA synthase that aligns with amino acid residue 268 of SEQ ID NO. 119 is alanine;

xxvi) an amino acid residue of the ketoacyl-CoA synthase that aligns with amino acid residue 271 of SEQ ID NO. 119 is isoleucine;

xxvii) an amino acid residue of the ketoacyl-CoA synthase that aligns with amino acid residue 274 of SEQ ID NO. 119 is glutamic acid;

xxviii) an amino acid residue of the ketoacyl-CoA synthase that aligns with amino acid residue 278 of SEQ ID NO. 119 is arginine, glutamic acid, aspartic acid, glutamine;

xxix) an amino acid residue of the ketoacyl-CoA synthase that aligns with amino acid residue 280 of SEQ ID NO. 119 is isoleucine;

xxx) an amino acid residue of the ketoacyl-CoA synthase that aligns with amino acid residue 282 of SEQ ID NO. 119 is glycine;

xxxi) an amino acid residue of the ketoacyl-CoA synthase that aligns with amino acid residue 296 of SEQ ID NO. 119 is alanine;

xxxii) an amino acid residue of the ketoacyl-CoA synthase that aligns with amino acid residue 302 of SEQ ID NO. 119 is threonine;

xxxiii) an amino acid residue of the ketoacyl-CoA synthase that aligns with amino acid residue 312 of SEQ ID NO. 119 is aspartic acid;

xxxiv) an amino acid residue of the ketoacyl-CoA synthase that aligns with amino acid residue 313 of SEQ ID NO. 119 is glutamic acid or methionine;

xxxv) an amino acid residue of the ketoacyl-CoA synthase that aligns with amino acid residue 315 of SEQ ID NO. 119 is lysine;

xxxvi) an amino acid residue of the ketoacyl-CoA synthase that aligns with amino acid residue 317 of SEQ ID NO. 119 is alanine;

xxxvii) an amino acid residue of the ketoacyl-CoA synthase that aligns with amino acid residue 322 of SEQ ID NO. 119 is glycine;

xxxviii) an amino acid residue of the ketoacyl-CoA synthase that aligns with amino acid residue 328 of SEQ ID NO. 119 is glycine;

xxxix) an amino acid residue of the ketoacyl-CoA synthase that aligns with amino acid residue 329 of SEQ ID NO. 119 is glycine;

xl) an amino acid residue of the ketoacyl-CoA synthase that aligns with amino acid residue 344 of SEQ ID NO. 119 is glutamic acid, aspartic acid or asparagine; xli) an amino acid residue of the ketoacyl-CoA synthase that aligns with amino acid residue 356 of SEQ ID NO. 119 is glycine or serine;

xlii) an amino acid residue of the ketoacyl-CoA synthase that aligns with amino acid residue 368 of SEQ ID NO. 119 is arginine; and xliii) an amino acid residue of the ketoacyl-CoA synthase that aligns with amino acid residue 370 of SEQ ID NO. 119 is threonine.

70. The ketoacyl-CoA synthase of embodiment 69 wherein the amino acid residue of the ketoacyl-CoA synthase that aligns with amino acid residue 184 of SEQ ID NO. 119 is isoleucine, leucine, methionine or valine.

71. The ketoacyl-CoA synthase of embodiment 69 wherein the amino acid residue of the ketoacyl-CoA synthase that aligns with amino acid residue 184 of SEQ ID NO. 119 is isoleucine.

72. The ketoacyl-CoA synthase of any of embodiments 69-71 wherein:

the amino acid residue of the ketoacyl-CoA synthase that aligns with amino acid residue 268 of SEQ ID NO. 119 is alanine;

the amino acid residue of the ketoacyl-CoA synthase that aligns with amino acid residue 296 of SEQ ID NO. 119 is alanine; and the amino acid residue of the ketoacyl-CoA synthase that aligns with amino acid residue 328 of SEQ ID NO. 119 is glycine.

73. The ketoacyl-CoA synthase of any of embodiments 69-72 wherein the amino acid residue of the ketoacyl-CoA synthase that aligns with amino acid residue 317 of SEQ ID NO. 119 is alanine.

74. The ketoacyl-CoA synthase of any of embodiments 70-73 wherein the amino acid residue of the ketoacyl-CoA synthase that aligns with amino acid residue 30 of SEQ ID NO. 119 is alanine.

75. The ketoacyl-CoA synthase of any of embodiments 70-74 wherein the amino acid residue of the ketoacyl-CoA synthase that aligns with amino acid residue 368 of SEQ ID NO. 119 is arginine.

76. The ketoacyl-CoA synthase of any of embodiments 69-75 wherein the amino acid residue of the ketoacyl-CoA synthase that aligns with amino acid residue 51 of SEQ ID NO. 119 is alanine, cysteine, aspartic acid, histidine, isoleucine, lysine, leucine, methionine, asparagine, proline, glutamine, arginine, serine, threonine, valine, tryptophan or tyrosine.

77. The ketoacyl-CoA synthase of any of embodiments 69-76 wherein the amino acid residue of the ketoacyl-CoA synthase that aligns with amino acid residue 51 of SEQ ID NO. 119 is alanine.

78. The 3-ketoacyl-CoA synthase having an amino acid sequence selected from the group consisting of any of SEQ ID NOs. 121-157.

79. A ketoacyl-CoA synthase having SEQ ID NO. 110 or being at least 80% identical to SEQ ID NO. 110, comprising in each case at least one of features i)-xiii):
  i) an amino acid residue of the ketoacyl-CoA synthase that aligns with amino acid residue 30 of SEQ ID NO. 110 is alanine;
  ii) an amino acid residue of the ketoacyl-CoA synthase that aligns with amino acid residue 39 of SEQ ID NO. 110 is valine;
  iii) an amino acid residue of the ketoacyl-CoA synthase that aligns with amino acid residue 69 of SEQ ID NO. 110 is valine;
  iv) an amino acid residue of the ketoacyl-CoA synthase that aligns with amino acid residue 111 of SEQ ID NO. 110 is cysteine;
  v) an amino acid residue of the ketoacyl-CoA synthase that aligns with amino acid residue 152 of SEQ ID NO. 110 is cysteine, leucine, methionine or threonine;
  vi) an amino acid residue of the ketoacyl-CoA synthase that aligns with amino acid residue 178 of SEQ ID NO. 110 is leucine;
  vii) an amino acid residue of the ketoacyl-CoA synthase that aligns with amino acid residue 184 of SEQ ID NO. 110 is isoleucine, leucine, methionine or valine;
  viii) an amino acid residue of the ketoacyl-CoA synthase that aligns with amino acid residue 268 of SEQ ID NO. 110 is alanine;
  ix) an amino acid residue of the ketoacyl-CoA synthase that aligns with amino acid residue 271 of SEQ ID NO. 110 is isoleucine;
  x) an amino acid residue of the ketoacyl-CoA synthase that aligns with amino acid residue 278 of SEQ ID NO. 110 is arginine;
  xi) an amino acid residue of the ketoacyl-CoA synthase that aligns with amino acid residue 296 of SEQ ID NO. 110 is alanine;
  xii) an amino acid residue of the ketoacyl-CoA synthase that aligns with amino acid residue 317 of SEQ ID NO. 110 is alanine;
  xiii) an amino acid residue of the ketoacyl-CoA synthase that aligns with amino acid residue 328 of SEQ ID NO. 110 is glycine.

80. The ketoacyl-CoA synthase of embodiment 79 wherein the amino acid residue of the ketoacyl-CoA synthase that aligns with amino acid residue 184 of SEQ ID NO. 120 is isoleucine, leucine, methionine or valine.

81. The ketoacyl-CoA synthase of embodiment 79 wherein the amino acid residue of the ketoacyl-CoA synthase that aligns with amino acid residue 184 of SEQ ID NO. 120 is isoleucine.

82. The ketoacyl-CoA synthase of any of embodiments 79-81 wherein:
  the amino acid residue of the ketoacyl-CoA synthase that aligns with amino acid residue 268 of SEQ ID NO. 120 is alanine;
  the amino acid residue of the ketoacyl-CoA synthase that aligns with amino acid residue 296 of SEQ ID NO. 120 is alanine; and
  the amino acid residue of the ketoacyl-CoA synthase that aligns with amino acid residue 328 of SEQ ID NO. 120 is glycine.

83. The ketoacyl-CoA synthase of any of embodiments 79-82 wherein the amino acid residue of the ketoacyl-CoA synthase that aligns with amino acid residue 317 of SEQ ID NO. 120 is alanine.

84. The ketoacyl-CoA synthase of any of embodiments 80-83 wherein the amino acid residue of the ketoacyl-CoA synthase that aligns with amino acid residue 30 of SEQ ID NO. 120 is alanine.

85. The ketoacyl-CoA synthase of any of embodiments 80-84 wherein the amino acid residue of the ketoacyl-CoA synthase that aligns with amino acid residue 368 of SEQ ID NO. 120 is arginine.

86. A ketoacyl-CoA synthase having SEQ ID NO. 110 or being at least 80% identical to SEQ ID NO. 110, comprising in each case at least one of features i)-xiii):
  i) an amino acid residue of the ketoacyl-CoA synthase that aligns with amino acid residue 30 of SEQ ID NO. 110 is alanine;
  ii) an amino acid residue of the ketoacyl-CoA synthase that aligns with amino acid residue 39 of SEQ ID NO. 110 is valine;
  iii) an amino acid residue of the ketoacyl-CoA synthase that aligns with amino acid residue 69 of SEQ ID NO. 110 is valine;
  iv) an amino acid residue of the ketoacyl-CoA synthase that aligns with amino acid residue 111 of SEQ ID NO. 110 is cysteine;
  v) an amino acid residue of the ketoacyl-CoA synthase that aligns with amino acid residue 152 of SEQ ID NO. 110 is cysteine, leucine, methionine or threonine;
  vi) an amino acid residue of the ketoacyl-CoA synthase that aligns with amino acid residue 178 of SEQ ID NO. 110 is leucine;
  vii) an amino acid residue of the ketoacyl-CoA synthase that aligns with amino acid residue 184 of SEQ ID NO. 110 is isoleucine, leucine, methionine or valine;
  viii) an amino acid residue of the ketoacyl-CoA synthase that aligns with amino acid residue 268 of SEQ ID NO. 110 is alanine;
  ix) an amino acid residue of the ketoacyl-CoA synthase that aligns with amino acid residue 271 of SEQ ID NO. 110 is isoleucine;
  x) an amino acid residue of the ketoacyl-CoA synthase that aligns with amino acid residue 278 of SEQ ID NO. 110 is arginine;
  xi) an amino acid residue of the ketoacyl-CoA synthase that aligns with amino acid residue 296 of SEQ ID NO. 110 is alanine;
  xii) an amino acid residue of the ketoacyl-CoA synthase that aligns with amino acid residue 317 of SEQ ID NO. 110 is alanine;
  xiii) an amino acid residue of the ketoacyl-CoA synthase that aligns with amino acid residue 328 of SEQ ID NO. 110 is glycine.

87. The ketoacyl-CoA synthase of embodiment 86 wherein the amino acid residue of the ketoacyl-CoA synthase that aligns with amino acid residue 184 of SEQ ID NO. 110 is isoleucine, leucine, methionine or valine.

88. The ketoacyl-CoA synthase of embodiment 86 wherein the amino acid residue of the ketoacyl-CoA synthase that aligns with amino acid residue 184 of SEQ ID NO. 110 is isoleucine.

89. The ketoacyl-CoA synthase of any of embodiments 86-88 wherein:
  the amino acid residue of the ketoacyl-CoA synthase that aligns with amino acid residue 268 of SEQ ID NO. 110 is alanine;
  the amino acid residue of the ketoacyl-CoA synthase that aligns with amino acid residue 296 of SEQ ID NO. 110 is alanine; and the amino acid residue of the ketoacyl-CoA synthase that aligns with amino acid residue 328 of SEQ ID NO. 110 is glycine.

90. The ketoacyl-CoA synthase of any of embodiments 86-89 wherein the amino acid residue of the ketoacyl-CoA synthase that aligns with amino acid residue 317 of SEQ ID NO. 110 is alanine.

91. The ketoacyl-CoA synthase of any of embodiments 87-90 wherein the amino acid residue of the ketoacyl-CoA synthase that aligns with amino acid residue 30 of SEQ ID NO. 110 is alanine.

92. The ketoacyl-CoA synthase of any of embodiments 87-91 wherein the amino acid residue of the ketoacyl-CoA synthase that aligns with amino acid residue 368 of SEQ ID NO. 110 is arginine.

93. A 3-ketoacyl-CoA synthase having an acid sequence characterized in including SEQ ID. NO. 170.

94. A 3-ketoacyl-CoA synthase gene encoding for a 3-ketoacyl-CoA synthase of any of embodiments 1-93.

95. A genetically modified cell comprising a heterologous nucleic acid sequence encoding a 3-ketoacyl-CoA synthase of any of embodiments 1-93.

96. A genetically modified cell comprising a 3-ketoacyl-CoA synthase gene of embodiment 94.

97. The genetically modified cell of embodiment 95 or 96 wherein the 3-ketoacyl-CoA synthase is malonyl-CoA-dependent.

98. The genetically modified cell of any of embodiment 95-97 which further comprises a heterologous nucleic acid sequence that encodes a malonyl-CoA-dependent 3-ketohexanoyl-CoA synthase.

99. The genetically modified cell of embodiment 98 wherein the heterologous nucleic acid sequence that encodes a malonyl-CoA-dependent 3-ketohexanoyl-CoA synthase includes SEQ ID. NO. 82.

100. The genetically modified cell of embodiment 98 wherein the heterologous nucleic acid sequence that encodes a malonyl-CoA-dependent 3-ketohexanoyl-CoA synthase includes SEQ ID. NO. 82 in which amino acid residue 100 is leucine, amino acid residue 147 is serine, threonine or phenylalanine, amino acid residue 217 is valine and amino acid residue 323 is valine.

101. The genetically modified cell of any of embodiments 95-100 which further comprises a heterologous nucleic acid sequence that encodes a malonyl-CoA-dependent 3-ketobutyryl-CoA synthase.

102. The genetically modified cell of embodiment 101 wherein the heterologous nucleic acid sequence that encodes a malonyl-CoA-dependent 3-ketobutyryl-CoA synthase includes SEQ ID. NO. 83.

103. The genetically modified cell of any of embodiments 95-102 further comprising a heterologous nucleic acid sequence that encodes a 3-ketoacyl-CoA reductase.

104. The genetically modified cell of embodiment 103 wherein the 3-ketoacyl-CoA reductase has or is at least 80% identical to any one of SEQ. ID. NO. 103, SEQ. ID. NO. 102 or SEQ. ID. NO. 101.

105. The genetically modified cell of any of embodiments 95-104 further comprising a heterologous nucleic acid sequence that encodes a 3-hydroxyacyl-CoA dehydratase.

106. The genetically modified cell of any of embodiments 95-105 further comprising a heterologous nucleic acid sequence that encodes for an enzyme that reduces a 3-ketoacyl-CoA to form a corresponding 3-hydroxyacyl-CoA and dehydrates the 3-ketoacyl-CoA to form a corresponding 2-trans-enoyl-CoA.

107. The genetically modified cell of embodiment 106 wherein the heterologous nucleic acid sequence that encodes for an enzyme that reduces a 3-ketoacyl-CoA to form a corresponding 3-hydroxyacyl-CoA and dehydrates the 3-hydroxyacyl-CoA to form a corresponding 2-trans-enoyl-CoA has or is at least 80% identical to SEQ. ID. NO. 98.

108. The genetically modified cell of any of embodiments 95-107 further comprising a heterologous nucleic acid sequence that encodes an enoyl-CoA reductase.

109. The genetically modified cell of any of embodiments 95-108 further comprising a heterologous nucleic acid sequence that encodes an ester synthase.

110. The genetically modified cell of any of embodiments 95-109 further comprising a deletion of a native LDH gene.

111. The genetically modified cell of any of embodiments 95-110 further comprising a deletion of a native pyruvate formate lyase gene.

112. The genetically modified cell of any of embodiments 95-111 further comprising deletion of a native methylglyoxal synthase gene.

113. The genetically modified cell of any of embodiments 95-112 further comprising a deletion of a native phosphotransacetylase gene.

114. The genetically modified cell of any of embodiments 95-113 further comprising a deletion of a native thioesterase gene.

115. The genetically modified cell of any of embodiments 95-114 further comprising a deletion of a native adhE gene.

116. The genetically modified cell of any of embodiments 95-115 further comprising a deletion of a native atoDAEB operon.

117. The genetically modified cell of any of embodiments 95-116 further comprising deletion of a native fadD gene.

118. The genetically modified cell of any of embodiments 95-111 further comprising a deletion of a native phosphotransacetylase gene.

119. The genetically modified cell of any of embodiments 95-118 further comprising a heterologous nucleic acid sequence that encodes for any of a fatty acyl-CoA reductase, a fatty aldehyde reductase, an acyl-ACP reductase, an acyl-CoA:ACP acyltransferase, a thioesterase, an acyl-CoA hydrolase, a carboxylic acid reductase, a CoA hydrolase, an aldehyde dehydrogenase, a carboxylic acid reductase and an acyl-ACP reductase.

120. The genetically modified cell of any of embodiments 95-119 which is a bacteria.

121. The genetically modified cell of embodiment 120 wherein the bacteria is *E. coli*.

122. A process for making one or more compounds having a straight-chain alkyl group, comprising culturing the genetically modified cell of any of embodiments 95-121 in a fermentation medium and recovering the compound(s) having a straight-chain alkyl group from the fermentation medium.

123. The process of embodiment 122 wherein at least 40% by weight of the compound(s) having a straight-chain alkyl group have 6-10 carbon atoms in the straight-chain alkyl group.

124. The process of embodiment 122 wherein at least 60% by weight of the compound(s) having a straight-chain alkyl group have 6-10 carbon atoms in the straight-chain alkyl group.

125. The process of any of embodiments 122-124 wherein the compound(s) having a straight-chain alkyl group are fatty alcohols.

126. The process of any of embodiments 122-124 wherein the compound(s) having a straight-chain alkyl group are fatty amides.
127. The process of any of embodiments 122-124 wherein the compound(s) having a straight-chain alkyl group are fatty diacids or fatty diacid esters.
128. The process of any of embodiments 122-124 wherein the compound(s) having a straight-chain alkyl group are fatty acids.
129. The process of any of embodiments 122-124 wherein the compound(s) having a straight-chain alkyl group fatty acid esters.
130. The process of embodiment 129 wherein the fatty acid esters are methyl and/or ethyl esters.
131. The process of embodiment 130 wherein the fermentation medium includes methanol and/or ethanol.
132. The process of any of embodiments 122-131 wherein at least 60% by weight of the compound(s) having a straight-chain alkyl group have 8 carbon atoms in the straight-chain alkyl group.
133. The process of any of embodiments 122-131 wherein at least 80% by weight of the compound(s) having a straight-chain alkyl group have 8 carbon atoms in the straight-chain alkyl group.
134. The process of any of embodiments 122-131 wherein at least 90% by weight of the compound(s) having a straight-chain alkyl group have 8 carbon atoms in the straight-chain alkyl group.
135. The process of any of embodiments 122-131 wherein at least 60% by weight of the compound(s) having a straight-chain alkyl group have 10 carbon atoms in the straight-chain alkyl group.
136. The process of any of embodiments 122-131 wherein at least 80% by weight of the compound(s) having a straight-chain alkyl group have 10 carbon atoms in the straight-chain alkyl group.
137. The process of any of embodiments 122-131 wherein at least 90% by weight of the compound(s) having a straight-chain alkyl group have 8 carbon atoms in the straight-chain alkyl group.
138. The process of any of embodiments 122-131 wherein at least 95% by weight of the compound(s) having a straight-chain alkyl group have 8 carbon atoms in the straight-chain alkyl group.
139. The process of any of embodiments 122-138 wherein at least 0.05 grams of the one or more compound(s) having a straight-chain alkyl group are produced per liter of fermentation broth per hour.
140. The process of any of embodiments 122-138 wherein at least 0.1 grams of the one or more compound(s) having a straight-chain alkyl group are produced per liter of fermentation broth per hour.
141. The process of any of embodiments 122-138 wherein at least 0.25 grams of the one or more compound(s) having a straight-chain alkyl group are produced per liter of fermentation broth per hour.
142. Use of a genetically modified cell of any of embodiments 95-121 to produce one or more compounds having a straight-chain alkyl group, wherein at least 60% by weight of the one or more compounds has 6 to 10 carbon atoms in the straight-chain alkyl group.
145. Use of a genetically modified cell of any of embodiments 95-121 to produce one or more compounds having a straight-chain alkyl group, wherein at least 80% by weight of the one or more compounds has 8 to 10 carbon atoms in the straight-chain alkyl group.
146. A cell that produces a 3-ketoacyl-CoA synthase of any of embodiments 1-93.

SEQUENCE LISTING (204 sequences)

SEQ ID NO: 1 - protein, 9 aa, Artificial
  Sub-sequence of mutant 3-ketoacyl-CoA synthase
  MISC_FEATURE (2)..(2): Leu or Met
  MISC_FEATURE (8)..(8): Leu, Val, Ile or Met
LXVNVEIXS

SEQ ID NO: 2 - protein, 10 aa, Artificial
  Sub-sequence of mutant 3-ketoacyl-CoA synthase
  MISC_FEATURE (6)..(6): Ile or Met
VNPEIXTGHM

SEQ ID NO: 3 - protein, 10 aa, Artificial
  Sub-sequence for 3-ketoacyl-CoA synthase
  MISC_FEATURE (6)..(6): Ile, Met, Leu, Thr, Cys, Val, Gly, Phe, Asp, Asn or Tyr
VNPEFXSPQV

SEQ ID NO: 4 - protein, 7 aa, Artificial
  Sub-sequence of mutant 3-ketoacyl-CoA synthase
  MISC_FEATURE (3)..(3): Cys, Met, His or Asn
DMXVACS

SEQ ID NO: 5 - protein, 7 aa, Artificial
  Sub-sequence of mutant 3-ketoacyl-CoA synthase
  MISC_FEATURE (7)..(7): Ala, Ile, Leu or Val
WLHQANX

SEQ ID NO: 6 - protein, 7 aa, Artificial
  Sub-sequence of mutant 3-ketoacyl-CoA synthase
  MISC_FEATURE (4)..(4): Gly or Ser
ANTXSAG

SEQ ID NO: 7 - protein, 9 aa, Artificial
  Sub-sequence of mutant 3-ketoacyl-CoA synthase
  MISC_FEATURE (2)..(2): Leu or Met
LXVNVEIIS

SEQ ID NO: 8 - protein, 370 aa, Acinetobacter schindleri CIP 107287
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 9 - protein, 370 aa, Artificial
  Mutated 3-ketoacyl synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIVSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 10 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIMSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 11 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 12 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEILSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 13 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMTVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 14 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMLVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 15 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMMVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 16 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMCVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 17 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVVEKTGILDPKRLRPLLHERSNDELSIQAEWGVAAAKQAMENAGVTAEDIDVVILSCSNIQRAYPALAIEIQTALGIQGYAYDMCVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTGSAGVIIALHRTANEVNDGEYGVLCSFGAGYSVGSILVKKHVA

SEQ ID NO: 18 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENACVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTGSAGVIIALHRTANEVNDGEYGVLCSFGAGYSVGSILVKKHVA

SEQ ID NO: 19 - protein, 370 aa, Artificial
  Mutated 3-ketoacyl-CoA synthase
MGIRITGTGLFHPTDFITNEELVESLNAYVEQYNLENAVKIAAGEIEELRGSSAEFIEKASGIKRRYVAEKTGILDPKRLRPLLHERSNDELSIQAEWGVAAAKQAMENACVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTGSAGVIIALHRTANEVNDGEYGVLCSFGAGYSVGSILVKKHVA

SEQ ID NO: 20 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 21 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANVNMNELILKLIVGKEHAKSELAPLILDEFANTGSAGVIIALHRTANEVNDGEYGVLCSFGAGYSVGSILVKKHVA

SEQ ID NO: 22 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGIAAAKQAMDNAGVTAEDIDVVILSCSNIQRAYPALAIEIQTALGIQGYAYDMNVACSAATFGIKQAADAIKSGARRVLMVNVEIVSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 23 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGIAAAKQAMDNAGVTAEDIDVVILSCSNIQRAYPALAIEIQTALGIQGYAYDMNVACSAATFGIKQAADAIKSGARRVLMVNVEIMSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 24 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGIAAAKQAMDNAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 25 - protein, 370 aa, Artificial
  Mutated 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGIAAAKQAMDNAGVTAEDIDVVILSCSNIQRAYPALAIEIQTALGIQGYAYDMNVACSAATFGIKQAADAIKSGARRVLMVNVEILSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 26 - protein, 369 aa, Artificial
  Mutated 3-ketoacyl-CoA synthase
MGIRITGTGLFHPEHVITNEELVESLNAYVELFNHENADKIAAGEVEARRGSSADFIEKASGVQRRYVVEKSGILDPKRLRPNLRERADDEISLQAEWGVIAAKQAMENAGVTAEDIDIVILSCSNLQRAYPAVAIEIQTALGIKGYAYDMNVACSAATFGLKQAYDAIKAGARRVLLVNVEIVSAHTDFRSRDCHFIFGDVATASIIENTDSKTGFEILDSELFTQFSNNIRNNFGFLNTSENADIDDKRFRQDGRKVFKEVCPLVAKMITAQLEKNQIEPTGVKRFWLHQANASMNELILKLVVGKENAKPGLVPIILNEFANTSSAGVIIALHRTAHEVEDGEYGVLCSFGAGYSVGSILVQKRVA

SEQ ID NO: 27 - protein, 369 aa, Artificial
  Mutated 3-ketoacyl-CoA synthase
MGIRITGTGLFHPEHVITNEELVESLNAYVELFNHENADKIAAGEVEARRGSSADFIEKASGVQRRYVVEKSGILDPKRLRPNLRERADDEISLQAEWGVIAAKQAMENAGVTAEDIDIVILSCSNLQRAYPAVAIEIQTALGIKGYAYDMNVACSAATFGLKQAYDAIKAGARRVLLVNVEIMSAHTDFRSRDCHFIFGDVATASIIENTDSKTGFEILDSELFTQFSNNIRNNFGFLNTSENADIDDKRFRQDGRKVFKEVCPLVAKMITAQLEKNQIEPTGVKRFWLHQANASMNELILKLVVGKENAKPGLVPIILNEFANTSSAGVIIALHRTAHEVEDGEYGVLCSFGAGYSVGSILVQKRVA

SEQ ID NO: 28 - protein, 369 aa, Artificial
  Mutated 3-ketoacyl-CoA synthase
MGIRITGTGLFHPEHVITNEELVESLNAYVELFNHENADKIAAGEVEARRGSSADFIEKASGVQRRYVVEKSGILDPKRLRPNLRERADDEISLQAEWGVIAAKQAMENAGVTAEDIDIVILSCSNLQRAYPAVAIEIQTALGIKGYAYDMNVACSAATFGLKQAYDAIKAGARRVLLVNVEIISAHTDFRSRDCHFIFGDVATASIIENTDSKTGFEILDSELFTQFSNNIRNNFGFLNTSENADIDDKRFRQDGRKVFKEVCPLVAKMITAQLEKNQIEPTGVKRFWLHQANASMNELILKLVVGKENAKPGLVPIILNEFANTSSAGVIIALHRTAHEVEDGEYGVLCSFGAGYSVGSILVQKRVA

SEQ ID NO: 29 - protein, 369 aa, Artificial
  Mutated 3-ketoacyl-CoA synthase
MGIRITGTGLFHPEHVITNEELVESLNAYVELFNHENADKIAAGEVEARRGSSADFIEKASGVQRRYVVEKSGILDPKRLRPNLRERADDEISLQAEWGVIAAKQAMENAGVTAEDIDIVILSCSNLQRAYPAVAIEIQTALGIKGYAYDMNVACSAATFGLKQAYDAIKAGARRVLLVNVEILSAHTDFRSRDCHFIFGDVATASIIENTDSKTGFEILDSELFTQFSNNIRNNFGFLNTSENADIDDKRFRQDGRKVFKEVCPLVAKMITAQLEKNQIEPTGVKRFWLHQANASMNELILKLVVGKENAKPGLVPIILNEFANTSSAGVIIALHRTAHEVEDGEYGVLCSFGAGYSVGSILVQKRVA

SEQ ID NO: 30 - protein, 370 aa, Artificial
  Mutated 3-ketoacyl-CoA synthase
MGIRITGTGLYHPEDIITNEELVESLNAYVEQYNLDNADKIASGELEARRGSSAEFIEKASGVKRRYVVEKTGILDPKRLRPLLHERSNDELSIQAEWGVIAAKQAMENAGVTAEDIDVVILSCSNLQRAYPAVAIEIQTALGIQGYAYDMNVACSAATFGIKQAYDAIKAGGRRVLLVNVEIVSGHTDYRSRDCHFIFGDVATASIIEETDSKTGFEIEDINLFTQFSNNIRNNFGFLNLSEVDADIENNRFAQDGRKVFKEVCPLVAKMITAQLEKNNIAPTDVKRFWLHQANASMNELILKLVVGKENAQPDLVPIILDEFANTSSAGVIIALHRTADQVNDGEYGVLCSFGAGYSVGAVLVKKHVA

SEQ ID NO: 31 - protein, 369 aa, Artificial
  Mutated 3-ketoacyl-CoA synthase
MGIRITGTGLFHPENVITNEELVESLNAYVELFNHENADKIAAGEIEARRGSSAEFIEKASGVQRRYVAEKSGILDPKRLRPNLPERADDEISLQAEWGVIAAKQAMENAGVTAEDIDIVILSCSNLQRAYPAVAIEIQTALGIKGYAYDMNVACSAATFGLKQAYDAIKAGARRVLLVNVEIVSAHTDFRSRDCHFIFGDVATASIIENTESKTGFEILDSELFTQFSNNIRNNFGFLNTSENADIDDKRFRQDGRKVFKEVCPLVAKMITAQLEKNQIAPTGVKRFWLHQANASMNELILKLVVGKENAKPGLVPMILNEFANTSSAGVIIALHRTAHEVEDGEYGVLCSFGAGYSVGSILVQKRVA

SEQ ID NO: 32 - protein, 369 aa, Artificial
  Mutated 3-ketoacyl synthase
MGIRITGTGLFHPENVITNEELVESLNAYVELFNHENADKIAAGEIEARRGSSAEFIEKASGVQRRYVAEKSGILDPKRLRPNLPERADDEISLQAEWGVIAAKQAMENAGVTAEDIDIVILSCSNLQRAYPAVAIEIQTALGIKGYAYDMNVACSAATFGLKQAYDAIKAGARRVLLVNVEIMSAHTDFRSRDCHFIFGDVATASIIENTESKTGFEILDSELFTQFSNNIRNNFGFLNTSENADIDDKRFRQDGRKVFKEVCPLVAKMITAQLEKNQIAPTGVKRFWLHQANASMNELILKLVVGKENAKPGLVPMILNEFANTSSAGVIIALHRTAHEVEDGEYGVLCSFGAGYSVGSILVQKRVA

SEQ ID NO: 33 - protein, 369 aa, Artificial
  Mutated 3-ketoacyl-CoA synthase
MGIRITGTGLFHPENVITNEELVESLNAYVELFNHENADKIAAGEIEARRGSSAEFIEKASGVQRRYVAEKSGILDPKRLRPNLPERADDEISLQAEWGVIAAKQAMENAGVTAEDIDIVILSCSNLQRAYPAVAIEIQTALGIKGYAYDMNVACSAATFGLKQAYDAIKAGARRVLLVNVEIISAHTDFRSRDCHFIFGDVATASIIENTESKTGFEILDSELFTQFSNNIRNNFGFLNTSENADIDDKRFRQDGRKVFKEVCPLVAKMITAQLEKNQIAPTGVKRFWLHQANASMNELILKLVVGKENAKPGLVPMILNEFANTSSAGVIIALHRTAHEVEDGEYGVLCSFGAGYSVGSILVQKRVA

SEQ ID NO: 34 - protein, 369 aa, Artificial
  Mutated 3-ketoacyl-CoA synthase
MGIRITGTGLFHPENVITNEELVESLNAYVELFNHENADKIAAGEIEARRGSSAEFIEKASGVQRRYVAEKSGILDPKRLRPNLPERADDEISLQAEWGVIAAKQAMENAGVTAEDIDIVILSCSNLQRAYPAVAIEIQTALGIKGYAYDMNVACSAATFGLKQAYDAIKAGARRVLLVNVEILSAHTDFRSRDCHFIFGDVATASIIENTESKTGFEILDSELFTQFSNNIRNNFGFLNTSENADIDDKRFRQDGRKVFKEVCPLVAKMITAQLEKNQIAPTGVKRFWLHQANASMNELILKLVVGKENAKPGLVPMILNEFANTSSAGVIIALHRTAHEVEDGEYGVLCSFGAGYSVGSILVQKRVA

SEQ ID NO: 35 - protein, 370 aa, Acinetobacter johnsonii
MGIRITGTGLYHPEDIITNEELVESLNAYVEQYNLDNADKIASGELEARRGSSAEFIEKASGVKRRYVVEKTGILDPKRLRPLLHERSNDELSIQAEWGVIAAKQAMENAGVTAEDIDVVILSCSNLQRAYPAVAIEIQTALGIQGYAYDMNVACSAATFGIKQAYDAIKAGGRRVLLVNVEITSGHTDYRSRDCHFIFGDVATASIIEETDSKTGFEIEDINLFTQFSNNIRNNFGFLNLSEVDADIENNRFAQDGRKVFKEVCPLVAKMITAQLEKNNIAPTDVKRFWLHQANASMNELILKLVVGKENAQPDLVPIILDEFANTSSAGVIIALHRTADQVNDGEYGVLCSFGAGYSVGAVLVKKHVA

SEQ ID NO: 36 - protein, 370 aa, Artificial
  Mutated 3-ketoacyl-CoA synthase
MGIRITGTGLFHPTDFITNEELVESLNAYVEQYNLENAVKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTGGAGVIIALHRTANEVNDGEYGVLCSFGAGYSVGSILVKKHVA

SEQ ID NO: 37 - protein, 370 aa, Artificial
  Mutated 3-ketoacyl-CoA synthase
MGIRITGTGLYHPEDIITNEELVESLNAYVEQYNLDNADKIASGELEARRGSSAEFIEKASGVKRRYVVEKTGILDPKRLRPLLHERSNDELSIQAEWGVIAAKQAMENAGVTAEDIDVVILSCSNLQRAYPAVAIEIQTALGIQGYAYDMNVACSAATFGIKQAYDAIKAGGRRVLLVNVEIMSGHTDYRSRDCHFIFGDVATASIIEETDSKTGFEIEDINLFTQFSNNIRNNFGFLNLSEVDADIENNRFAQDGRKVFKEVCPLVAKMITAQLEKNNIAPTDVKRFWLHQANASMNELILKLVVGKENAQPDLVPIILDEFANTSSAGVIIALHRTADQVNDGEYGVLCSFGAGYSVGAVLVKKHVA

SEQ ID NO: 38 - protein, 370 aa, Artificial
  Mutated 3-ketoacyl-CoA synthase
MGIRITGTGLYHPEDIITNEELVESLNAYVEQYNLDNADKIASGELEARRGSSAEFIEKASGVKRRYVVEKTGILDPKRLRPLLHERSNDELSIQAEWGVIAAKQAMENAGVTAEDIDVVILSCSNLQRAYPAVAIEIQTALGIQGYAYDMNVACSAATFGIKQAYDAIKAGGRRVLLVNVEIISGHTDYRSRDCHFIFGDVATASIIEETDSKTGFEIEDINLFTQFSNNIRNNFGFLNLSEVDADIENNRFAQDGRKVFKEVCPLVAKMITAQLEKNNIAPTDVKRFWLHQANASMNELILKLVVGKENAQPDLVPIILDEFANTSSAGVIIALHRTADQVNDGEYGVLCSFGAGYSVGAVLVKKHVA

SEQ ID NO: 39 - protein, 370 aa, Artificial
  Mutated 3-ketoacyl-CoA synthase
MGIRITGTGLYHPEDIITNEELVESLNAYVEQYNLDNADKIASGELEARRGSSAEFIEKASGVKRRYVVEKTGILDPKRLRPLLHERSNDELSIQAEWGVIAAKQAMENAGVTAEDIDVVILSCSNLQRAYPAVAIEIQTALGIQGYAYDMNVACSAATFGIKQAYDAIKAGGRRVLLVNVEILSGHTDYRSRDCHFIFGDVATASIIEETDSKTGFEIEDINLFTQFSNNIRNNFGFLNLSEVDADIENNRFAQDGRKVFKEVCPLVAKMITAQLEKNNIAPTDVKRFWLHQANASMNELILKLVVGKENAQPDLVPIILDEFANTSSAGVIIALHRTADQVNDGEYGVLCSFGAGYSVGAVLVKKHVA

SEQ ID NO: 40 - protein, 373 aa, Artificial
  Mutated 3-ketoacyl-CoA synthase
  MISC_FEATURE (186)..(186): Ile or Met
MYNVVISGTGLYTPASSISNDELVESFNTYVHRFNSENAAAIEAGEVQPLAESSSAFIEKASGIKSRYVTDKAGILDPERMVPRIPERSNDEWSILCEMSVKAAEEALARAGKTAADIDGVIVACSNLQRAYPAIAIEVQAALGIKGFGFDMNVACSSATFGIQNAVNSIKLGQARAILMVNPEIXTGHMNFRDRDSHFIFGDACTAVVIEREDLATSAHQWEVLSTKLVTEFSNNIRNNFGFLNRTAEEYMSNPDKLFIQEGRKVFKEVCPMVAELIGEHLSENGIAVESVKRFWLHQANLNMNHLIVRKLLGRDATEEEAPVILDTYANTSSAGSVIAFHKHQDDLPSGSLGVLSSFGAGYSIGSVILRKR

SEQ ID NO: 41 - protein, 10 aa, Artificial
  Sub-sequence of mutated 3-ketoacyl-CoA synthase
VNPEFISPQV

SEQ ID NO: 42 - protein, 372 aa, Artificial
  Mutated 3-ketoacyl-CoA synthase
  MISC_FEATURE (186)..(186): Ile, Met, Leu, Cys, Val, Gln, Phe, Asp, Asn, Try
MQQVVISGSGLFTPQHRISNEELVQSYNQYVDQFNEEHAAAIAAGEIEALEYSSTEFIEKASGIKARHVLYKDGILDPKIMHPVFRKRGEDELPEMVEMAVQAATQALAQANKTAADIDLIICAASNMQRPYPALSVELQQALGAGGYAFDMNVACSSATFAISNAVNAIRGGTAKVVLVVNPEFXSPQVDYRSRDSHFIFGDVCTATIIEAESSCSSQQAFRILGMRLKTTFSNNIRCDIGYTEHCFTEQDPKAPFFKQQGRKVFKELLPIVADVIQDEMAAQNLAPDDLKRLWLHQANINMNIFAAKKILGRDPLPEEAPLVLDTYANTASAGSIIAFHKYQQGLVSGDKAILCSFGAGYSVGCVVLEKC

SEQ ID NO: 43 - protein, 372 aa, Artificial
  Mutated 3-ketoacyl-CoA synthase
MQQVVISGSGLFTPQHRISNEELVQSYNQYVDQFNEEHAAAIAAGEIEALEYSSTEFIEKASGIKARHVLYKDGILDPKIMHPVFRKRGEDELPEMVEMAVQAATQALAQANKTAADIDLIICAASNMQRPYPALSVELQQALGAGGYAFDMNVACSSATFAISNAVNAIRGGTAKVVLVVNPEFISPQVDYRSRDSHFIFGDVCTATIIEAESSCSSQQAFRILGMRLKTTFSNNIRCDIGYTEHCFTEQDPKAPFFKQQGRKVFKELLPIVADVIQDEMAAQNLAPDDLKRLWLHQANINMNIFAAKKILGRDPLPEEAPLVLDTYANTASAGSIIAFHKYQQGLVSGDKAILCSFGAGYSVGCVVLEKC

SEQ ID NO: 44 - protein, 36 aa, Artificial
  Sub-sequence of mutated 3-ketoacyl-CoA synthase
  MISC_FEATURE (3)..(3): Cys, Met, His, Asn or Thr
  MISC_FEATURE (13)..(13): Leu, Ile
  MISC_FEATURE (17)..(17): Ala or Tyr
  MISC_FEATURE (22)..(22): Ala or Ser
  MISC_FEATURE (24)..(24): Ala or Gly
  MISC_FEATURE (29)..(29): Leu or Met
  MISC_FEATURE (35)..(35): Leu, Val, Ile or Met
DMXVACSAATFGXKQAXDAIKXGXRRVLXVNVEIXS

SEQ ID NO: 45 - protein, 89 aa, Artificial
  Sub-sequence of mutated 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Ala or Tyr
  MISC_FEATURE (22)..(22): Ala or Ser
  MISC_FEATURE (24)..(24): Ala or Gly
  MISC_FEATURE (29)..(29): Leu or Met
  MISC_FEATURE (35)..(35): Leu, Val, Ile or Met
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or Tyr
DMXVACSAATFGXKQAXDAIKXGXRRVLXVNVEIXSXHTDXRSRXCHFIFGDVATASIIEXTXXKTGFEIXDXXLFTQFSNNIRNNFGX

SEQ ID NO: 46 - protein, 49 aa, Artificial
  Sub-sequence of mutated 3-ketoacyl-CoA synthase
  MISC_FEATURE (7)..(7): Ala, Val, Ile or Leu
  MISC_FEATURE (8)..(8): Ser or Asn
  MISC_FEATURE (15)..(15): Lys, Met or Gly
  MISC_FEATURE (17)..(17): Ile or Val
  MISC_FEATURE (20)..(20): Glu or Lys
  MISC_FEATURE (22)..(22): His or Asn
  MISC_FEATURE (24)..(24): Gln or Lys
  MISC_FEATURE (25)..(25): Pro or Ser
  MISC_FEATURE (26)..(26): Gly, Asp or Glu
  MISC_FEATURE (28)..(28): Val or Ala
  MISC_FEATURE (30)..(30): Met, Ile or Leu
  MISC_FEATURE (31)..(31): Ile or Val
  MISC_FEATURE (33)..(33): Asp or Asn
  MISC_FEATURE (39)..(39): Ser or Gly
  MISC_FEATURE (45)..(45): Ile or Val
WLHQANXXMNELILXLXVGXEXAXXXLXPXXLXEFANTXSAGVIXALHR

SEQ ID NO: 47 - protein, 189 aa, Artificial
  Sub-sequence of 3-ketoacyl-CoA synthase
  MISC_FEATURE (3)..(3): Cys, Met, His, Asn or Thr
  MISC_FEATURE (13)..(13): Ile or Leu
  MISC_FEATURE (17)..(17): Ala or Tyr
  MISC_FEATURE (22)..(22): Ala or Ser
  MISC_FEATURE (24)..(24): Gly or Ala
  MISC_FEATURE (29)..(29): Leu or Met
  MISC_FEATURE (35)..(35): Leu, Val, Ile or Met
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or tyr
  MISC_FEATURE (92)..(92): Thr or Leu
  MISC_FEATURE (95)..(95): Val or missing
  MISC_FEATURE (96)..(96): Asn or Asp
  MISC_FEATURE (100)..(100): Asp or Glu
  MISC_FEATURE (101)..(101): Asp or Asn
  MISC_FEATURE (102)..(102): Lys or Asn
  MISC_FEATURE (105)..(105): Ala or Arg
  MISC_FEATURE (119)..(119): Ala or Val
  MISC_FEATURE (122)..(122): Ile or Met
  MISC_FEATURE (125)..(125): Ala or Lys
  MISC_FEATURE (129)..(129): Lyr or Arg
  MISC_FEATURE (131)..(131): Asn or Gln
  MISC_FEATURE (133)..(133): Ala or Glu
  MISC_FEATURE (136)..(136): Gly, Asp or Asn
  MISC_FEATURE (147)..(147): Ala, Val, Ile or Leu
  MISC_FEATURE (148)..(148): Ser or Asn
  MISC_FEATURE (155)..(155): Lys, Met or Gln
  MISC_FEATURE (157)..(157): Ile or Val
  MISC_FEATURE (160)..(160): Glu or Lys
  MISC_FEATURE (162)..(162): Asn or His
  MISC_FEATURE (164)..(164): Lys or Gln
  MISC_FEATURE (165)..(165): Pro or Ser
  MISC_FEATURE (166)..(166): Gly, Asp or Glu
  MISC_FEATURE (168)..(168): Val or Ala
  MISC_FEATURE (170)..(170): Met, Ile or Leu
  MISC_FEATURE (171)..(171): Ile or Val
  MISC_FEATURE (173)..(173): Asn or Asp
  MISC_FEATURE (179)..(179): Ser or Gly
  MISC_FEATURE (185)..(185): Ile or Val
DMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLXPXXLXEFANTXSAGVIXALHR

SEQ ID NO: 48 - protein, 149 aa, Artificial
  Sub-sequence of mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Als or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAY

SEQ ID NO: 49 - protein, 338 aa, Artificial
  Sub-sequence of mutated 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly  or Ala
  MISC_FEATURE (178)..(178): Leu or Met
  MISC_FEATURE (184)..(184): Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Valine or missing
  MISC_FEATURE (245)..(245): Asn or Asp
  MISC_FEATURE (249)..(249): Asn or Asp
  MISC_FEATURE (250)..(250): Asp or Glu
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLXPXXLXEFANTXSAGVIXALHR

SEQ ID NO: 50 - protein, 7 aa, Artificial
  Sub-sequence of mutant 3-ketoacyl-Coa synthase
  MISC_FEATURE (6)..(6): Gln or Asn
QLERNXI

SEQ ID NO: 51 - protein, 9 aa, Artificial
  Sub-sequence of mutant 3-ketoacyl-CoA synthase
  MISC_FEATURE (2)..(2): Leu or Met
  MISC_FEATURE (8)..(8): Thr, Leu, Val, Ile or Met
LXVNVEIXS

SEQ ID NO: 52 - protein, 36 aa, Artificial; identical to SEQ ID NO: 44
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
  MISC_FEATURE (29)..(29): Leu or Met
  MISC_FEATURE (35)..(35): Thr, Leu, Val, Ile or Met

SEQ ID NO: 53 - protein, 89 aa, Artificial; identical to SEQ ID NO: 45
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or ALA
  MISC_FEATURE (29)..(29): Leu or Met
  MISC_FEATURE (35)..(35): Thr, Val, Ile or Met
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or Tyr

SEQ ID NO: 54 - protein, 189 aa, Artificial; identical to SEQ ID NO: 47
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
  MISC_FEATURE (29)..(29): Leu or Met
  MISC_FEATURE (35)..(35): Thr, Leu, Val, Ile or Met
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or Tyr
  MISC_FEATURE (92)..(92): Thr or Leu
  MISC_FEATURE (95)..(95): Val or missing
  MISC_FEATURE (96)..(96): Asn or Asp
  MISC_FEATURE (100)..(100): Asp or Glu
  MISC_FEATURE (101)..(101): Asp or Asn
  MISC_FEATURE (102)..(102): Lys or Asn
  MISC_FEATURE (105)..(105): Arg or Ala
  MISC_FEATURE (119)..(119): Val or Ala
  MISC_FEATURE (122)..(122): Met or Ile
  MISC_FEATURE (125)..(125): Ala or Lys
  MISC_FEATURE (129)..(129): Lys or Arg
  MISC_FEATURE (131)..(131): Gln or Asn
  MISC_FEATURE (133)..(133): Glu or Ala
  MISC_FEATURE (136)..(136): Gly, Asp or Asn
  MISC_FEATURE (147)..(147): Ala, Val, Ile or Leu
  MISC_FEATURE (148)..(148): Ser or Asn
  MISC_FEATURE (155)..(155): Lys, Met or Gln
  MISC_FEATURE (157)..(157): Val or Ile
  MISC_FEATURE (160)..(160): Glu or Lys
  MISC_FEATURE (162)..(162): Asn or His
  MISC_FEATURE (164)..(164): Lys or Gln
  MISC_FEATURE (165)..(165): Pro or Ser
  MISC_FEATURE (166)..(166): Gly, Asp or Glu
  MISC_FEATURE (168)..(168): Val or Ala
  MISC_FEATURE (170)..(170): Met, Ile or Leu
  MISC_FEATURE (171)..(171): Ile or Val
  MISC_FEATURE (173)..(173): Asn or Asp
  MISC_FEATURE (179)..(179): Ser or Gly
  MISC_FEATURE (185)..(185): Ile or Val

SEQ ID NO: 55 - protein, 338 aa, Artificial
  Sub-sequence of mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asg
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile, Leu or Phe
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (210)..(210): Glu or Asn
  MISC_FEATURE (212)..(212): Asp or Glu
  MISC_FEATURE (213)..(213): Asp or Glu
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Missing or Val
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Arg or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Ans
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRDCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLXPXXLXEFANTXSAGVIXALHR

SEQ ID NO: 56 - protein, 10 aa, Artificial
  Sub-sequence of mutant 3-ketoacyl-CoA synthase
LHQANANMNE

SEQ ID NO: 57 - protein, 49 aa, Artificial
  Sub-sequence for mutant 3-ketoacyl-CoA synthase
  MISC_FEATURE (15)..(15): Lys, Met or Gln
  MISC_FEATURE (17)..(17): Val or Ile
  MISC_FEATURE (20)..(20): Glu or Lys
  MISC_FEATURE (22)..(22): Asn or His
  MISC_FEATURE (24)..(24): Lys or Gln
  MISC_FEATURE (25)..(25): Pro or Ser
  MISC_FEATURE (26)..(26): Gly, Asp or Glu
  MISC_FEATURE (28)..(28): Val or Ala
  MISC_FEATURE (30)..(30): Met, Ile or Leu
  MISC_FEATURE (31)..(31): Ile or Val
  MISC_FEATURE (33)..(33): Asn or Asp
  MISC_FEATURE (39)..(39): Ser or Gly
  MISC_FEATURE (45)..(45): Ile or Val
WLHQANANMNELILXLXVGXEXAXXXLXPXXLXEFANTXSAGVIXALHR

SEQ ID NO: 58 - protein, 189 aa, Artificial
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
  MISC_FEATURE (29)..(29): Leu or Met
  MISC_FEATURE (35)..(35): Thr, Met, Val, Ile or Leu
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or Tyr
  MISC_FEATURE (92)..(92): Thr or Leu
  MISC_FEATURE (95)..(95): Val or missing
  MISC_FEATURE (96)..(96): Asn or Asp
  MISC_FEATURE (100)..(100): Asp or Glu
  MISC_FEATURE (101)..(101): Asp or Asn
  MISC_FEATURE (102)..(102): Lys or Asn
  MISC_FEATURE (105)..(105): Arg or Ala
  MISC_FEATURE (119)..(119): Val or Ala
  MISC_FEATURE (122)..(122): Met or Ile
  MISC_FEATURE (125)..(125): Ala or Lys
  MISC_FEATURE (129)..(129): Lys or Arg
  MISC_FEATURE (131)..(131): Gln or Asn
  MISC_FEATURE (133)..(133): Glu or Ala
  MISC_FEATURE (136)..(136): Gly, Asp or Asn
  MISC_FEATURE (155)..(155): Lys, Met or Gln
  MISC_FEATURE (157)..(157): Val or Ile
  MISC_FEATURE (160)..(160): Glu or Lys
  MISC_FEATURE (162)..(162): Asn or His
  MISC_FEATURE (164)..(165): Lys or Gln
  MISC_FEATURE (165)..(165): Pro or Ser
  MISC_FEATURE (166)..(166): Gly, Asp or Glu
  MISC_FEATURE (168)..(168): Val or Ala
  MISC_FEATURE (170)..(170): Met, Ile or Leu
  MISC_FEATURE (171)..(171): Ile or Val
  MISC_FEATURE (173)..(173): Asn or Asp
  MISC_FEATURE (179)..(179): Ser or Gly
  MISC_FEATURE (185)..(187): Ile or Val
DMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANANMNELILXLXVGXEXAXXXLXPXXLXEFANTXSAGVIXALHR

SEQ ID NO: 59 - protein, 338 aa, Artificial
  Sub-sequence of mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Als or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Ans
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(283): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (304)..(304): Lys, Met or Gln
  MISC_FEATURE (306)..(306): Val or Ala
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANANMNELILXLXVGXEXAXXXLXPXXLXEFANTXSAGVIXALHR

SEQ ID NO: 60 - protein, 14 aa, Artificial
  Sub-sequence of mutant 3-ketoacyl-CoA synthase
LLVNVEITSGHTDF

SEQ ID NO: 61 - protein, 41 aa, Artificial
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
DMXVACSAATFGXKQAXDAIKXGXRRVLLVNVEITSGHTDF

SEQ ID NO: 62 - protein, 89 aa, Artificial
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Phe or Tyr
  MISC_FEATURE (89)..(89): Thr or Leu
DMXVACSAATFGXKQAXDAIKXGXRRVLLVNVEITSGHTDFRSRXCHFIFGDVATASIIEXTXXKTGFEIXDXXLFTQFSNNIRNNFGX

SEQ ID NO: 63 - protein, 189 aa, Artificial
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or Tyr
  MISC_FEATURE (92)..(92): Thr or Leu
  MISC_FEATURE (95)..(95): Val or missing
  MISC_FEATURE (96)..(96): Asn or Asp
  MISC_FEATURE (101)..(101): Asp or Ans
  MISC_FEATURE (102)..(102): Lys or Asn
  MISC_FEATURE (105)..(105): Arg or Ala
  MISC_FEATURE (119)..(119): Val or Ala
  MISC_FEATURE (122)..(122): Met or Ile
  MISC_FEATURE (125)..(125): Ala or Lys
  MISC_FEATURE (129)..(129): Lys or Arg
  MISC_FEATURE (131)..(131): Gln or Asn
  MISC_FEATURE (133)..(133): Glu or Ala
  MISC_FEATURE (136)..(136): Gly, Asp or Asn
  MISC_FEATURE (147)..(147): Ala, Val, Ile or Leu
  MISC_FEATURE (148)..(148): Ser or Asn
  MISC_FEATURE (155)..(155): Lys, Met, Gln
  MISC_FEATURE (157)..(157): Val or Ile
  MISC_FEATURE (160)..(160): Glu or Lys
  MISC_FEATURE (162)..(162): Asn or His
  MISC_FEATURE (164)..(165): Lys or Gln
  MISC_FEATURE (165)..(165): Pro or Ser
  MISC_FEATURE (166)..(166): Gly, Asp or Glu
  MISC_FEATURE (168)..(168): Val or Ala
  MISC_FEATURE (170)..(170): Met, Ile or Leu
  MISC_FEATURE (171)..(171): Ile or Val
  MISC_FEATURE (173)..(173): Asn or Asp
  MISC_FEATURE (179)..(179): Ser or Gly
  MISC_FEATURE (185)..(185): Ile or Val
DMXVACSAATFGXKQAXDAIKXGXRRVLLVNVEITSGHTDFRSRXCHFIFGDVATASIIEXTXXKTGFEIXDXXLFTQFSNNIRNNFGXLNXSEXXADIDXXRFXQDGRKVFKEVCPLXAKXITXQLEXNXIXPTXVKRFWLHQANXXMNELILXLXVGXEXAXXXLXPXXLXEFANTXSAGVIXALHR

SEQ ID NO: 64 - protein, 338 aa, Artificial
  Sub-sequence of mutant 3-ketoacyl-CoA synthase
  MISC_FEATURE (11)..(11): Phe or Tyr
  MISC_FEATURE (14)..(14): Gly or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Arg, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Gly or Lys
  MISC_FEATURE (311)..(311): Asn or Lys
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLLVNVEITSGHTDFRSRXCHFIFGDVATASIIEXTXXKTGFEIXDXXLFTQFSNNIRNNFGXLNXSEXXADIDXXRFXQDGRKVFKEVCPLXAKXITXQLEXNXIXPTXVKRFWLHQANXXMNELILXLXVGXEXAXXXLXPXXLXEFANTXSAGVIXALHR

SEQ ID NO: 65 - protein, 16 aa, Artificial
  Sub-sequence of mutant 3-ketoacyl-CoA synthase
  MISC_FEATURE (4)..(4): Met, Ile or Leu
  MISC_FEATURE (7)..(7): Asn or Asp
  MISC_FEATURE (13)..(13): Ser or Gly
LAPXILXEFANTXSAG

SEQ ID NO: 66 - protein, 49 aa, Artificial
  Sub-sequence of mutant 3-ketoacyl-CoA synthase
  MISC_FEATURE (7)..(7): Ala, Val, Ile or Leu
  MISC_FEATURE (8)..(8): Ser or Asn
  MISC_FEATURE (15)..(15): Lys, Met or Gln
  MISC_FEATURE (17)..(17): Val or Ile
  MISC_FEATURE (20)..(20): Glu or Lys
  MISC_FEATURE (22)..(22): Asn or His
  MISC_FEATURE (24)..(24): Lys or Gln
  MISC_FEATURE (25)..(25): Pro or Ser
  MISC_FEATURE (26)..(26): Gly, Asp or Glu
  MISC_FEATURE (30)..(30): Met, Ile or Leu
  MISC_FEATURE (33)..(33): Asn or Asp
  MISC_FEATURE (39)..(39): Ser or Gly
  MISC_FEATURE (45)..(45): Ile or Val
WLHQANXXMNELILXLXVGXEXAXXXLAPXILXEFANTXSAGVIXALHR

SEQ ID NO: 67 - protein, 189 aa, Artificial
  Sub-sequence of mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
  MISC_FEATURE (29)..(29): Leu or Met
  MISC_FEATURE (35)..(35): Thr, Leu, Val, Ile or Met
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(65): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or Tyr
  MISC_FEATURE (92)..(92): Thr or Leu
  MISC_FEATURE (95)..(95): Val or missing
  MISC_FEATURE (96)..(96): Asn or Asp
  MISC_FEATURE (100)..(100): Asp or Glu
  MISC_FEATURE (101)..(101): Asp or Asn
  MISC_FEATURE (102)..(102): Lys or Asn
  MISC_FEATURE (105)..(105): Arg or Ala
  MISC_FEATURE (119)..(119): Val or Ala
  MISC_FEATURE (122)..(122): Met or Ile
  MISC_FEATURE (125)..(125): Ala or Lys
  MISC_FEATURE (129)..(129): Lys or Arg
  MISC_FEATURE (131)..(131): Gln or Asn
  MISC_FEATURE (133)..(133): Glu or Ala
  MISC_FEATURE (136)..(136): Gly, Asp or Asn
  MISC_FEATURE (147)..(147): Ala, Val, Ile or Leu
  MISC_FEATURE (148)..(148): Ser or Asn
  MISC_FEATURE (155)..(155): Lys, Met or Gln
  MISC_FEATURE (157)..(157): Val or Ile
  MISC_FEATURE (160)..(160): Glu or Lys
  MISC_FEATURE (162)..(162): Asn or His
  MISC_FEATURE (164)..(164): Lys or Gln
  MISC_FEATURE (165)..(165): Pro or Ser
  MISC_FEATURE (166)..(166): Gly, Asp or Glu
  MISC_FEATURE (170)..(170): Met, Ile or Leu
  MISC_FEATURE (173)..(173): Asn or Asp
  MISC_FEATURE (179)..(179): Ser or Gly
  MISC_FEATURE (185)..(185): Ile or Val
DMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLAPXILXEFANTXSAGVIXALHR

SEQ ID NO: 68 - protein, 338 aa, Artificial
  Sub-sequence of mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Thr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (315)..(315): Gly, Asp or Glu
  MISC_FEATURE (319)..(319): Met, Ile or Leu
  MISC_FEATURE (322)..(322): Asn or Asp
  MISC_FEATURE (328)..(328): Ser or Gly
  MISC_FEATURE (334)..(334): Ile or Val
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIDXXRFXQDGRKVFKEVCPLXAKXITXQLEXNXIXPTXVKRFWLHQANXXMNELILXLXVGXEXAXXXLAPXILXEFANTXSAGVIXALHR

SEQ ID NO: 69 - protein, 9 aa, Artificial
  Sub-sequence for mutant 3-ketoacyl-CoA synthase
  MISC_FEATURE (3)..(3): Val or Ala
  MISC_FEATURE (9)..(9): Ala or Lys
PLXAKIITX

SEQ ID NO: 70 - protein, 189 aa, Artificial
  Sub-sequence for mutant 3-ketoacyl-CoA synthase
  MISC_FEATURE (3)..(3): Cys, Met, His, Asn or Thr
  MISC_FEATURE (13)..(13): Leu or Ile
  MISC_FEATURE (17)..(17): Tyr or Ala
  MISC_FEATURE (22)..(22): Ala or Ser
  MISC_FEATURE (24)..(24): Gly or Ala
  MISC_FEATURE (29)..(29): Leu or Met
  MISC_FEATURE (35)..(35): Thr, Leu, Val, Ile or Met
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu or Asn
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (89)..(89): Phe or Tyr
  MISC_FEATURE (92)..(92): Thr or Leu
  MISC_FEATURE (95)..(95): Val or missing
  MISC_FEATURE (96)..(96): Asn or Asp
  MISC_FEATURE (100)..(100): Asp or Glu
  MISC_FEATURE (101)..(101): Asp or Asn
  MISC_FEATURE (102)..(102): Lys or Asn
  MISC_FEATURE (105)..(105): Arg or Ala
  MISC_FEATURE (119)..(119): Val or Ala
  MISC_FEATURE (125)..(125): Ala or Lys
  MISC_FEATURE (129)..(129): Lys or Arg
  MISC_FEATURE (131)..(131): Gln or Asn
  MISC_FEATURE (133)..(133): Glu or Ala
  MISC_FEATURE (136)..(136): Gly, Asp or Asn
  MISC_FEATURE (147)..(147): Ala, Val, Ile or Leu
  MISC_FEATURE (148)..(148): Ser or Asn
  MISC_FEATURE (155)..(155): Lys, Met or Gln
  MISC_FEATURE (157)..(157): Val or Ile
  MISC_FEATURE (160)..(160): Glu or Lys
  MISC_FEATURE (162)..(162): Asn or His
  MISC_FEATURE (164)..(164): Lys or Gln
  MISC_FEATURE (165)..(165): Pro or Ser
  MISC_FEATURE (166)..(166): Gly, Asp or Glu
  MISC_FEATURE (168)..(168): Val or Ala
  MISC_FEATURE (170)..(170): Met, Ile or Val
  MISC_FEATURE (171)..(171): Ile or Val
  MISC_FEATURE (173)..(173): Asn or Asp
  MISC_FEATURE (179)..(179): Ser or Gly
  MISC_FEATURE (185)..(185): Ile or Val
DMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKIITXQLEXNXIXPTXVKRFWLHQANXXMNELILXLXVGXEXAXXXLXPXXLXEFANTXSAGVIXALHR

SEQ ID NO: 71 - protein, 338 aa, Artificial
  Sub-sequence of mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or HIs
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(382): Ser or Gly
  MISC_FEATURE (334)..(334): Ile or Val
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKIITXQLEXNXIXPTXVKRFWLHQANXXMNELILXLXVGXEXAXXXLXPXXLXEFANTXSAGVIXALHR

SEQ ID NO: 72 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLERNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 73 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANANMNELILKLIVGKEHAKSELVPLILDEFANTSSAGVIIALHRTANEVNDGEYGVLCSFGAGYSVGSILVKKHVA

SEQ ID NO: 74 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLERNQIEPTNVKRFWLHQANANMNELILKLIVGKEHAKSELVPLILDEFANTSSAGVIIALHRTANEVNDGEYGVLCSFGAGYSVGSILVKKHVA

SEQ ID NO: 75 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELAPLILDEFANTSSAGVIIALHRTANEVNDGEYGVLCSFGAGYSVGSILVKKHVA

SEQ ID NO: 76 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLERNQIEPTNVKRFWLHQANVNMNELILKLIVGKEHAKSELAPLILDEFANTSSAGVIIALHRTANEVNDGEYGVLCSFGAGYSVGSILVKKHVA

SEQ ID NO: 77 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANANMNELILKLIVGKEHAKSELAPLILDEFANTSSAGVIIALHRTANEVNDGEYGVLCSFGAGYSVGSILVKKHVA

SEQ ID NO: 78 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKIITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 79 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKIITKQLEKNQIEPTNVKRFWLHQANANMNELILKLIVGKEHAKSELVPLILDEFANTSSAGVIIALHRTANEVNDGEYGVLCSFGAGYSVGSILVKKHVA

SEQ ID NO: 80 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLLVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 81 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLLVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANANMNELILKLIVGKEHAKSELVPLILDEFANTSSAGVIIALHRTANEVNDGEYGVLCSFGAGYSVGSILVKKHVA

SEQ ID NO: 82 - protein, 329 aa, Artificial
  Mutant 3-ketoacyl-CoA synthase
  MISC_FEATURE (99)..(99): His or Leu
  MISC_FEATURE (147)..(147): Ser, Thr or Val
  MISC_FEATURE (217)..(217): Phe or Val
  MISC_FEATURE (323)..(323): Ser, Val or Ala
MTDVRFRIIGTGAYVPERIVSNDEVGAPAGVDDDWITRKTGIRQRRWAADDQATSDLATAAGRAALKAAGITPEQLTVIAVATSTPDRPQPPTAAYVQXLLGATGTAAFDVNAVCSGTVFALSSVAGTLVYRGGYALVIGADLYSRXLNPADRKTVVLFGDGAGAMVLGPTSTGTGPIVRRVALHTFGGLTDLIRVPAGGSRQPLDTDGLDAGLQYXAMDGREVRRFVTEHLPQLIKGFLHEAGVDAADISHFVPHQANGVMLDEVFGELHLPRATMHRTVETYGNTGAASIPITMDAAVRAGSFRPGELVLLAGFGGGMAAXFALIEW

SEQ ID NO: 83 - protein, 329 aa, Streptomyces sp. CL190
MTDVRFRIIGTGAYVPERIVSNDEVGAPAGVDDDWITRKTGIRQRRWAADDQATSDLATAAGRAALKAAGITPEQLTVIAVATSTPDRPQPPTAAYVQHHLGATGTAAFDVNAVCSGTVFALSSVAGTLVYRGGYALVIGADLYSRILNPADRKTVVLFGDGAGAMVLGPTSTGTGPIVRRVALHTFGGLTDLIRVPAGGSRQPLDTDGLDAGLQYFAMDGREVRRFVTEHLPQLIKGFLHEAGVDAADISHFVPHQANGVMLDEVFGELHLPRATMHRTVETYGNTGAASIPITMDAAVRAGSFRPGELVLLAGFGGGMAASFALIEW

SEQ ID NO: 84 - protein, 212 aa, Treponema denticola
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWEVGSNS

SEQ ID NO: 85 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGIFGEVVHVDGGFSIAAMNELELK

SEQ ID NO: 86 - protein, 370 aa, Acinetobacter schindleri NIPH 900
MGIRITGTGLFHPTDFITNEELVESLNAYVEQYNLENADKIAAGEIEELRGSSAEFIEKASGIKRRYVAEKTGILDPKRLRPLLHERSNDELSIQAEWGIAAAKQAMDNAGVTAEDIDVVILSCSNIQRAYPALAIEIQTALGIQGYAYDMNVACSAATFGIKQAADAIKSGARRVLMVNVEITSGHTDFRSRDCHFIFGDVATASIIEETETKTGFEIEDIELFTQFSNNIRNNFGYLNLSEVDADIDNNRFRQDGRKVFKEVCPLVAKMITKQLEKNQIEPTNVKRFWLHQANVNMNELILKLIVGKEHAKSELVPLILDEFANTSSAGVIIALHRTANEVNDGEYGVLCSFGAGYSVGSILVKKHVA

SEQ ID NO: 87 - protein, 9 aa, Artificial
  Sub-sequence of 3-ketoacyl-CoA synthase
  MISC_FEATURE (2)..(2): Leu or Met
LXVNVEITS

SEQ ID NO: 88 - protein, 369 aa, Acinetobacter lwoffii
MGIRITGTGLFHPEHVITNEELVESLNAYVELFNHENADKIAAGEVEARRGSSADFIEKASGVQRRYVVEKSGILDPKRLRPNLRERADDEISLQAEWGVIAAKQAMENAGVTAEDIDIVILSCSNLQRAYPAVAIEIQTALGIKGYAYDMNVACSAATFGLKQAYDAIKAGARRVLLVNVEITSAHTDFRSRDCHFIFGDVATASIIENTDSKTGFEILDSELFTQFSNNIRNNFGFLNTSENADIDDKRFRQDGRKVFKEVCPLVAKMITAQLEKNQIEPTGVKRFWLHQANASMNELILKLVVGKENAKPGLVPIILNEFANTSSAGVIIALHRTAHEVEDGEYGVLCSFGAGYSVGSILVQKRVA

SEQ ID NO: 89 - protein, 369 aa, Acinetobacter sp. NIPH 713
MGIRITGTGLFHPENVITNEELVESLNAYVELFNHENADKIAAGEIEARRGSSAEFIEKASGVQRRYVAEKSGILDPKRLRPNLPERADDEISLQAEWGVIAAKQAMENAGVTAEDIDIVILSCSNLQRAYPAVAIEIQTALGIKGYAYDMNVACSAATFGLKQAYDAIKAGARRVLLVNVEITSAHTDFRSRDCHFIFGDVATASIIENTESKTGFEILDSELFTQFSNNIRNNFGFLNTSENADIDDKRFRQDGRKVFKEVCPLVAKMITAQLEKNQIAPTGVKRFWLHQANASMNELILKLVVGKENAKPGLVPMILNEFANTSSAGVIIALHRTAHEVEDGEYGVLCSFGAGYSVGSILVQKRVA

SEQ ID NO: 90 - protein, 373 aa, Pseudomonas stutzeri ATCC 17588
MYNVVISGTGLYTPASSISNDELVESFNTYVHRFNSENAAAIEAGEVQPLAESSSAFIEKASGIKSRYVTDKAGILDPERMVPRIPERSNDEWSILCEMSVKAAEEALARAGKTAADIDGVIVACSNLQRAYPAIAIEVQAALGIKGFGFDMNVACSSATFGIQNAVNSIKLGQARAILMVNPEICTGHMNFRDRDSHFIFGDACTAVVIEREDLATSAHQWEVLSTKLVTEFSNNIRNNFGFLNRTAEEYMSNPDKLFIQEGRKVFKEVCPMVAELIGEHLSENGIAVESVKRFWLHQANLNMNHLIVRKLLGRDATEEEAPVILDTYANTSSAGSVIAFHKHQDDLPSGSLGVLSSFGAGYSIGSVILRKR

SEQ ID NO: 91 - protein, 372 aa, Alishewanella agri BL06
MQQVVISGSGLFTPQHRISNEELVQSYNQYVDQFNEEHAAAIAAGEIEALEYSSTEFIEKASGIKARHVLYKDGILDPKIMHPVFRKRGEDELPEMVEMAVQAATQALAQANKTAADIDLIICAASNMQRPYPALSVELQQALGAGGYAFDMNVACSSATFAISNAVNAIRGGTAKVVLVVNPEFASPQVDYRSRDSHFIFGDVCTATIIEAESSCSSQQAFRILGMRLKTTFSNNIRCDIGYTEHCFTEQDPKAPFFKQQGRKVFKELLPIVADVIQDEMAAQNLAPDDLKRLWLHQANINMNIFAAKKILGRDPLPEEAPLVLDTYANTASAGSIIAFHKYQQGLVSGDKAILCSFGAGYSVGCVVLEKC

SEQ ID NO: 92 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 93 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 94 - DNA, 23 bp, Artificial
  Primer
agggggtgtcgcccttggggctc

SEQ ID NO: 95 - DNA, 48 bp, Artificial
  Primer
gtttaactttaagaaggagatataccatgagcggtcaccaccaccatc

SEQ ID NO: 96 - protein, 227 aa, Artificial
  Mutant 3-ketoacyl-CoA synthase
MTDVRFRIIGTGAYVPERIVSNDEVGAPAGVDDDWITRKTGIRQRRWAADDQATSDLATAAGRAALKAAGITPEQLTVIAVATSTPDRPQPPTAAYVQHHLGATGTAAFDVNAVCSGTVFALSSVAGTLVYRGGYALVIGADLYSRSLNPADRKTVVLFGDGAGAMVLGPTSTGTGPIVRRVALHTFGGLTDLIRVPAGGSRQPLDTVVWTQACNMLRWMAAKSVAS

SEQ ID NO: 97 - protein, 16 aa, Artificial
  Sub-sequence of various naturally-occuring 3-ketoayl-CoA synthases
  MISC_FEATURE (4)..(4): Ile, Leu or Met
  MISC_FEATURE (7)..(7): Asp or Asn
LVPXILXEFANTSSAG

SEQ ID NO: 98 - protein, 729 aa, Escherichia coli
MVYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 99 - protein, 261 aa, Clostridium acetobutylicum
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 100 - protein, 355 aa, Pseudomonas putida
MSDTEVPVLAEVRNRVGHLALNRPVGLNALTLQMIRITWRQLHAWESDPEIVAVVLRANGEKAFCAGGDIRSLYDSYQAGDDLHHVFLEEKYSLDQYIHGYPKPIVALMDGFVLGGGMGLVQGTALRVVTERVKMGMPETSIGYFPDVGGSYFLPRLPGELGLYLGITGIQIRAADALYARLADWCLPSERISEFDRRLDQISWGYAPREILAGLLSSLASNRLLGAELKSLHPAIDEHFTQPDLSAIRASLQAERRPEYQDWAEQTVELLNNRSPLAMSATLKLLRLGRTLSLANCFELELHLERQWFAKGDLIEGVRALLIDKDKTPRWNPPTLEQLDTNRVNEFFDGFQPAT

SEQ ID NO: 101 - protein, 282 aa, Clostridium beijerinckii
MKKIFVLGAGTMGAGIVQAFAQKGCEVIVRDIKEEFVDRGIAGITKGLEKQVAKGKMSEEDKEAILSRISGTTDMKLAADCDLVVEAAIENMKIKKEIFAELDGICKPEAILASNTSSLSITEVASATKRPDKVIGMHFFNPAPVMKLVEIIKGIATSQETFDAVKELSVAIGKEPVEVAEAPGFVVNGILIPMINEASFILQEGIASVEDIDTAMKYGANHPMGPLALGDLIGLDVCLAIMDVLFTETGDNKYRASSILRKYVRAGWLGRKSGKGFYDYSK

SEQ ID NO: 102 - protein, 247 aa, Pseudomonas aeruginosa
MSLQGKVALVTGASRGIGQAIALELGRLGAVVIGTATSASGAEKIAETLKANGVEGAGLVLDVSSDESVAATLEHIQQHLGQPLIVVNNAGITRDNLLVRMKDDEWFDVVNTNLNSLYRLSKAVLRGMTKARWGRIINIGSVVGAMGNAGQTNYAAAKAGLEGFTRALAREVGSRAITVNAVAPGFIDTDMTRELPEAQREALLAQIPLGRLGQAEEIAKVVGFLASDGAAYVTGATVPVNGGMYMS

SEQ ID NO: 103 - protein, 247 aa, Pseudomonas aeruginosa
MSLQGKVALVTGASRGIGQAIALELGRLGAVVIGTATSASGAEKIAETLKANGVEGAGLVLDVSSDESVAATLEHIQQHLGQPLIVVNNAGITRDNLLVRMKDDEWFDVVNTNLNSLYRLSKAVLRGMTKARWGRIINIGSVVGAMGNAGQTNYAAAKAGLEGFTRALAREVGSRAITVNAVAPGFIDTDMTRELPEAQREALLGQIPLGRLGQAEEIAKVVGFLASDGAAYVTGATVPVNGGMYMS

SEQ ID NO: 104 - protein, 458 aa, Hahella chejuensis
MTPLSPVDQIFLWLEKRQQPMHVGGLHIFSFPDDADAKYMTELAQQLRAYATPQAPFNRRLRQRWGRYYWDTDAQFDLEHHFRHEALPKPGRIRELLAHVSAEHSNLMDRERPMWECHLIEGIRGRRFAVYYKAHHCMLDGVAAMRMCVKSYSFDPTATEMPPIWAISKDVTPARETQAPAAGDLVHSLSQLVEGAGRQLATVPTLIRELGKNLLKARDDSDAGLIFRAPPSILNQRITGSRRFAAQSYALERFKAIGKAFQATVNDVVLAVCGSALRNYLLSRQALPDQPLIAMAPMSIRQDDSDSGNQIAMILANLGTHIADPVRRLELTQASARESKERFRQMTPEEAVNYTALTLAPSGLNLLTGLAPKWQAFNVVISNVPGPNKPLYWNGARLEGMYPVSIPVDYAALNITLVSYRDQLEFGFTACRRTLPSMQRLLDYIEQGIAELEKAAGV

SEQ ID NO: 105 - protein, 10 aa, Artificial
  Sub-sequence of various naturally-occuring 3-ketoacyl-CoA synthases
VNPEICTGHM

SEQ ID NO: 106 - protein, 10 aa, Artificial
  Sub-sequence of various naturally-occuring 3-ketoacyl-CoA synthases
VNPEFASPQV

SEQ ID NO: 107 - protein, 9 aa, Artificial
  Sub-sequence of various naturally occuring 3-ketoacyl-CoA synthases
  MISC_FEATURE (3)..(3): Val or Ala
  MISC_FEATURE (9)..(9): Ala or Lys
PLXAKMITX

SEQ ID NO: 108 - protein, 7 aa, Artificial
  Sub-sequence of various naturally-occuring 3-ketoacyl-CoA synthases
  MISC_FEATURE (6)..(6): Gln or Asn
QLEKNXI

SEQ ID NO: 109 - protein, 10 aa, Artificial
  Sub-sequence from various naturally occuring 3-ketoacyl-CoA synthases
LHQANVNMNE

SEQ ID NO: 110 - protein, 370 aa, Artificial
  Mutant 3-ketoacyl-CoA enzyme
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Gln
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(223): Ser or Ile
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
  MISC_FEATURE (341)..(341): His, Asp or Asn
  MISC_FEATURE (342)..(342): Glu or Gln
  MISC_FEATURE (344)..(344): Glu or Asn
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLXPXXLXEFANTXSAGVIXALHRTAXXVXDGEYGVLCSFGAGYSVGXXLVXKXVA

SEQ ID NO: 111 - protein, 370 aa, Artificial
  Mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Asp or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Glu
  MISC_FEATURE (334)..(334): Ile or Val
  MISC_FEATURE (341)..(341): His, Asp or Asn
  MISC_FEATURE (342)..(342): Glu or Gln
  MISC_FEATURE (344)..(344): Glu or Asn
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRDCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLXPXXLXEFANTXSAGVIXALHRTAXXVXDGEYGVLCSFGAGYSVGXXLVXKXVA

SEQ ID NO: 112 - protein, 370 aa, Artificial
  Mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Tyr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
  MISC_FEATURE (341)..(341): His, Asp or Asn
  MISC_FEATURE (342)..(342): Glu or Gln
  MISC_FEATURE (344)..(344): Glu or Asn
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANANMNELILXLXVGXEXAXXXLXPXXLXEFANTXSAGVIXALHRTAXXVXDGEYGVLCSFGAGYSVGXXLVXKXVA

SEQ ID NO: 113 - protein, 370 aa, Artificial
  Mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(109): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Arg or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
  MISC_FEATURE (341)..(341): His, Asp or Asn
  MISC_FEATURE (342)..(342): Glu or Gln
  MISC_FEATURE (344)..(344): Glu or Asn
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLLVNVEITSGHTDFRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLXPXXLXEFANTXSAGVIXALHRTAXXVXDGEYGVLCSFGAGYSVGXXLVXKXVA

SEQ ID NO: 114 - protein, 370 aa, Artificial
  Mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (319)..(391): Met, Ile or Leu
  MISC_FEATURE (320)..(320): Ile or Val
  MISC_FEATURE (322)..(322): Asn or Asp
  MISC_FEATURE (328)..(328): Ser or Gln
  MISC_FEATURE (334)..(334): Ile or Val
  MISC_FEATURE (341)..(341): His, Asp or Asn
  MISC_FEATURE (342)..(342): Glu or Gln
  MISC_FEATURE (344)..(344): Glu or Asn
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKXITXQLEXNXIXPTXVKRFWLHQANXXMNELILXLXVGXEXAXXXLAPXXLXEFANTXSAGVIXALHRTAXXVXDGEYGVLCSFGAGYSVGXXLVXKXVA

SEQ ID NO: 115 - protein, 370 aa, Artificial
  Mutant 3-ketoacyl-Coa synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Tyr
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile, Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
  MISC_FEATURE (341)..(341): His, Asp or Asn
  MISC_FEATURE (342)..(342): Glu or Asn
  MISC_FEATURE (344)..(344): Glu or Asn
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTQFSNNIRNNFGXLNXSEXXADIXXXRFXQDGRKVFKEVCPLXAKIITXQLEXNXIXPTXVKRFWLHQANXXMNELILXLXVGXEXAXXXLXPXXLXEFANTXSAGVIXALHRTAXXVXDGEYGVLCSFGAGYSVGXXLVXKXVA

SEQ ID NO: 116 - protein, 14 aa, Acinetobacter schindleri CIP 107287
LMVNVEITSGHTDF

SEQ ID NO: 117 - DNA, 215 bp, Escherichia coli
gatcttgatatcaaacgaacgttttagcaggactgtcgtcggttgccaaccatctgcgagcaaagcatggcgttttgttgcgcgggatcagcaagcctagcggcagttgtttacgcttttattacagatttaataaattaccacattttaagaatattattaatctgtaatatatctttaacaatctcaggttaaaaactttcctgttttcaacg

SEQ ID NO: 118 - DNA, 121 bp, Escherichia coli
aaatcagactgaagactttatctctctgtcataaaactgtcatattccttacatataactgtcacctgtttgtcctattttgcttctcgtagccaacaaacaatgctttatgaatcctccc

SEQ ID NO: 119 - protein, 370 aa, Artificial
  Mutant 3-ketoayl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile,Phe, Thr or Ser
  MISC_FEATURE (18)..(18): Thr or Ala
  MISC_FEATURE (22)..(22): Leu or Met
  MISC_FEATURE (30)..(30): Val or Ala
  MISC_FEATURE (32)..(32): Leu, Gln, Glx, Arg or Gly
  MISC_FEATURE (33)..(33): Phe or Gln
  MISC_FEATURE (35)..(35): His or Leu
  MISC_FEATURE (36)..(36): Glu or Asp
  MISC_FEATURE (38)..(38): Ala or Val
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp, Gly, Ala, Cys, His, Ile, Lys, Leu, Met, Asn, Pro, Gln, Arg, Ser, Thr, Val, Trp or Tyr
  MISC_FEATURE (54)..(54): Ala or Val
  MISC_FEATURE (63)..(63): Val or Ile
  MISC_FEATURE (64)..(64): Lys, Gln, Glu or Gly
  MISC_FEATURE (69)..(69): Ala or Val
  MISC_FEATURE (72)..(72): Ser or Thr
  MISC_FEATURE (83)..(83): Asn, Leu, Asn, His or Phe
  MISC_FEATURE (85)..(85): Pro, His, Arg, Gln or Asp
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile, Leu,Thr, Glu or Ala
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (116)..(116): Asp or Gly
  MISC_FEATURE (119)..(119): Ile or Val
  MISC_FEATURE (127)..(127): Ile, Leu or Thr
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (154)..(154): Ala or Gly
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu, Met or Thr
  MISC_FEATURE (184)..(184): Leu, Val, Ile, Met, Cys or Thr
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu, Asn or Val
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu, His, Gln, Ser or Asn
  MISC_FEATURE (227)..(227): Gln, Lys, Thr or Asp
  MISC_FEATURE (231)..(231): Asn or Ile
  MISC_FEATURE (232)..(232): Ile or Val
  MISC_FEATURE (236)..(236): Phe or Leu
  MISC_FEATURE (238)..(238): Phe or Tyr
  MISC_FEATURE (241)..(241): Thr, Leu or Pro
  MISC_FEATURE (243)..(243): Glu, Phe, Gly or Pro
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala, Lys or Glu
  MISC_FEATURE (278)..(278): Lys, Glu, Asp, Gln or Arg
  MISC_FEATURE (280)..(280): Gln, Ala, His, Glu or Asn
  MISC_FEATURE (282)..(282): Glu, Ala or Gly
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (302)..(302): Ile or Thr
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (312)..(312): Ala or Asp
  MISC_FEATURE (313)..(313): Lys, Gln, Glu or Met
  MISC_FEATURE (314)..(314): Pro or Ser
  MISC_FEATURE (315)..(315): Gly, Asp, Glu or Lys
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn, Asp or Gly
  MISC_FEATURE (328)..(328): Ser or Gly
  MISC_FEATURE (329)..(329): Ser or Gly
  MISC_FEATURE (334)..(334): Ile or Val
  MISC_FEATURE (341)..(341): His, Asp or Asn
  MISC_FEATURE (342)..(342): Glu or Gln
  MISC_FEATURE (344)..(344): Glu, Pro, Asp or Asn
  MISC_FEATURE (356)..(356): Ala, Gly or Ser
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His
  MISC_FEATURE (370)..(370): Ala or Thr
MGIRITGTGLXHPXXXITNEELVESLNAYXEXXNXXNAXKIAXGEXEXXRXSSAEFIEKASGXXRRYVXEKXGILDPKRLRPXLXERXXDEXSXQAEWGXXAAKQAMXNAXVTAEDIDXVILSCSNXQRXYPAXAIEIQTALGIXGYAYDMXVACSAATFGXKQAXDAIKXGXRRVLXVNVEIXSXHTDXRSRXCHFIFGDVATASIIEXTXXKTGFEIXDXXLFTXFSNNIRNNFGXLNXSXXXADIXXXRFXQDGRKVFKEVCPLXAKXITXQLEXNXIXPTXVKRFWLHQANXXMNELILXLXVGXEXAXXXLXPXXLXEFANTXSAGVIXALHRTAXXVXDGEYGVLCSFGXGYSVGXXLVXKXVX

SEQ ID NO: 120 - protein, 370 aa, Artificial; identical to SEQ ID NO: 110
  Mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile or Phe
  MISC_FEATURE (30)..(30): Val or Ala
  MISC_FEATURE (32)..(32): Leu or Gln
  MISC_FEATURE (33)..(33): Phe or Gln
  MISC_FEATURE (35)..(35): His or Leu
  MISC_FEATURE (36)..(36): Glu or Asp
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp or Gly
  MISC_FEATURE (63)..(63): Val or Ile
  MISC_FEATURE (64)..(64): Gln or Lys
  MISC_FEATURE (69)..(69): Ala or Val
  MISC_FEATURE (72)..(72): Ser or Thr
  MISC_FEATURE (83)..(83): Asn or Leu
  MISC_FEATURE (85)..(85): Pro or His
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile or Leu
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (119)..(119): Ile or Val
  MISC_FEATURE (127)..(127): Ile or Leu
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or Thr
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu or Met
  MISC_FEATURE (184)..(184): Thr, Leu, Val, Ile or Met
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu or Asn
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu or Asn
  MISC_FEATURE (238)..(238): Phe or Tyr
  MISC_FEATURE (241)..(241): Thr or Leu
  MISC_FEATURE (244)..(244): Val or missing
  MISC_FEATURE (245)..(245): Asn or Asp
  MISC_FEATURE (249)..(249): Asp or Glu
  MISC_FEATURE (250)..(250): Asp or Asn
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala or Lys
  MISC_FEATURE (278)..(278): Lys or Arg
  MISC_FEATURE (280)..(280): Gln or Asn
  MISC_FEATURE (282)..(282): Glu or Ala
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (313)..(313): Lys or Gln
  MISC_FEATURE (314)..(314): Pro or Ser
  MISC_FEATURE (315)..(315): Gly, Asp or Glu
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn or Asp
  MISC_FEATURE (328)..(328): Ser or Gly
  MISC_FEATURE (334)..(334): Ile or Val
  MISC_FEATURE (341)..(341): His, Asp or Asn
  MISC_FEATURE (342)..(342): Glu or Gln
  MISC_FEATURE (344)..(344): Glu or Asn
  MISC_FEATURE (362)..(362): Ser or Ala
  MISC_FEATURE (363)..(363): Val or Ile
  MISC_FEATURE (366)..(366): Gln or Lys
  MISC_FEATURE (368)..(368): Arg or His

SEQ ID NO: 121 - protein, 370 aa, Artificial
  Mutane 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAESELVPLILDEFANTGSAGVIIALHRTANEVNDGEYGVLCSFGAGYSVGSILVKKHVT

SEQ ID NO: 122 - protein, 370 aa, Artificial
  Mutant 3-ketoacyl-CoA synthanse
MGIRITGTGLFHPTDFIANEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 123 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGGAGVIIALHRTANEVNDGEYGVLCSFGAGYSVGSILVKKHVA

SEQ ID NO: 124 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNTQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 125 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITEQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 126 - protein, 370 aa, Artificial
  Mutant 3-ketoacyl-CoA synthase
MGIRITGTGLFHPTDFITNEELVESLNAYVEQYNLENVDKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLTVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHDKSELVPLILDEFANTGSAGVIIALHRTANEVNDGEYGVLCSFGAGYSVGSILVKKHVA

SEQ ID NO: 127 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEGIDVVILSCSNIQRAYPALAIEIQTALGIQGYAYDMNVACSAATFGIKQAADAIKSGARRVLMVNVEIISGHTDYRSRDCHFIFGDVATASIIEETETKTGFEIEDIELFTQFSNNIRNNFGYLNPSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 128 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSTQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 129 - protein, 369 aa, Artificial
  Mutant 3-ketoacyl-CoA synthase
MGIRITGTGLFHPTDFITNEEMVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHASELVPLILDEFANTGSAGVIIALHRTANEVNDGEYGVLCSFGAGYSVGSILVKKHVA

SEQ ID NO: 130 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAESELVPLILDEFANTGSAGVIIALHRTANEVNDGEYGVLCSFGAGYSVGSILVKKHVA

SEQ ID NO: 131 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVT

SEQ ID NO: 132 - protein, 370 aa, Artificial
  Mutant 3-ketoacyl-CoA synthase
MGIRITGTGLFHPTDFIANEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAESELVPLILDEFANTGSAGVIIALHRTANEVNDGEYGVLCSFGAGYSVGSILVKKHVT

SEQ ID NO: 133 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAESELVPLILDEFANTGGAGVIIALHRTANEVNDGEYGVLCSFGAGYSVGSILVKKHVT

SEQ ID NO: 134 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNLGYLNLSEVDADIDNNRFRQDGRKVFKEVCPLAAKMITKQLEKNQIEPTNVKRFWLHQANANMNELILKLIVGKEHAESELAPLILDEFANTGSAGVIIALHRTANEVNDGEYGVLCSFGAGYSVGSILVKKHVA

SEQ ID NO: 135 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNMGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKHVA

SEQ ID NO: 136 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNVRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 137 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIGPTNVKRFWLHQANANMNELILKLIVGKEHAKSELVPLILDEFANTGSAGVIIALHRTANEVNDGEYGVLCSFGAGYSVGSILVKKHVA

SEQ ID NO: 138 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILGEFANTGSAGVIIALHRTANEVNDGEYGVLCSFGAGYSVGSILVKKHVA

SEQ ID NO: 139 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEVTETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 140 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSKLVPLILDEFANTGSAGVIIALHRTANEVNDGEYGVLCSFGAGYSVGSILVKKRVA

SEQ ID NO: 141 - protein, 370 aa, Artificial
  Mutant 3-ketoacyl-CoA synthase
MGIRITGTGLFHPTDFITNEELVESLNAYAEQYNLENADKIAAGEIEELRGSSVEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 142 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELTLKLIVGKEHAKSELVPLILDEFANTGSAGVIIALHRTANEVNDGEYGVLCSFGAGYSVGSILVKKRVA

SEQ ID NO: 143 - protein, 370 aa, Artificial
  Mutant 3-ketoacyl-CoA synthase
MGIRITGTGLFHPTDFITNEELVESLNAYAEQYNLENADKIAAGEIEELRGSSVEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELTLKLIVGKEHAKSELVPLILDEFANTGSAGVIIALHRTANEVNDGEYGVLCSFGAGYSVGSILVKKRVA

SEQ ID NO: 144 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 145 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGGGYSVGSILVKKRVA

SEQ ID NO: 146 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGSGYSVGSILVKKRVA

SEQ ID NO: 147 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVGCSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 148 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNVRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 149 - protein, 370 aa, Artificial
  Mutant 3-ketoacyl-CoA synthase
MGIRITGTGLFHPTDFITNEELVESLNAYAEQYNLENADKIAAGEIEELRGSSVEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVGCSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 150 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVGCSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELTLKLIVGKEHAKSELVPLILDEFANTGSAGVIIALHRTANEVNDGEYGVLCSFGAGYSVGSILVKKRVA

SEQ ID NO: 151 - protein, 370 aa, Artificial
  Mutant 3-ketoacyl-CoA synthase
MGIRITGTGLFHPTDFITNEELVESLNAYAEQYNLENADKIAAGEIEELRGSSVEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVGCSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELTLKLIVGKEHAKSELVPLILDEFANTGSAGVIIALHRTANEVNDGEYGVLCSFGAGYSVGSILVKKRVA

SEQ ID NO: 152 - protein, 370 aa, Artificial
  Mutant 3-ketoacyl-CoA synthase
MGIRITGTGLFHPTDFITNEELVESLNAYAEQYNLENADKIAAGEIEELRGSSVEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELTLKLIVGKEHAKSELVPLILDEFANTGSAGVIIALHRTANEVNDGEYGVLCSFGAGYSVGSILVKKRVA

SEQ ID NO: 153 - protein, 370 aa, Artificial
  Mutant 3-ketoacyl-CoA synthase
MGIRITGTGLFHPTDFITNEELVESLNAYAEQYNLENADKIAAGEIEELRGSSVEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 154 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELTLKLIVGKEHAKSELVPLILDEFANTGSAGVIIALHRTANEVNDGEYGVLCSFGAGYSVGSILVKKRVA

SEQ ID NO: 155 - protein, 370 aa, Artificial
  Mutant 3-ketoacyl-CoA synthase
MGIRITGTGLFHPTDFITNEELVESLNAYAEQYNLENADKIAAGEIEELRGSSVEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVGCSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 156 - protein, 370 aa, Artificial
  Mutant 3-ketoacyl-CoA synthase
MGIRITGTGLFHPTDFITNEELVESLNAYAEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVGCSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKIITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 157 - protein, 370 aa, Artificial
  Mutant 3-ketoacyl-CoA synthase
  MISC_FEATURE (51)..(51): Ala, Cys, Asp, His, Ile, Lys, Leu, Met, Asn, Pro, Gln, Arg, Ser, Thr, Val, Trp or Tyr
MGIRITGTGLFHPTDFITNEELVESLNAYVEQYNLENADKIAAGEIEELRXSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 158 - protein, 370 aa, Artificial
  Mutant 3-ketoacyl-CoA synthase
  MISC_FEATURE (51)..(51): Cys, Asp, Glu, Phe,His, Ile, Lys, Met, Asn, Pro, Arg, Ser, Thr, Trp or Tyr
MGIRITGTGLFHPTDFITNEELVESLNAYAEQYNLENADKIAAGEIEELRXSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLERNQIEPTNVKRFWLHQANANMNELILKLIVGKEHAKSELVPLILDEFANTGSAGVIIALHRTANEVNDGEYGVLCSFGAGYSVGSILVKKRVA

SEQ ID NO: 159 - protein, 370 aa, Artificial
  Mutant 3-ketoacyl-CoA synthase
  MISC_FEATURE (16)..(16): Phe, Thr, Val or Ser
  MISC_FEATURE (32)..(32): Gln, Leu, Arg or Gly
  MISC_FEATURE (64)..(64): Lys, Gln, Glu or Gly
  MISC_FEATURE (83)..(83): Leu, Asn, His or Phe
  MISC_FEATURE (85)..(85): His, Arg, Gln or Asp
  MISC_FEATURE (94)..(94): Ile, Leu, Glu or Ala
  MISC_FEATURE (184)..(184): Thr, Cys, Leu, Met or Ile
  MISC_FEATURE (223)..(223): Glu, His, Gln or Ser
  MISC_FEATURE (227)..(227): Gln, Lys, Thr or Asp
  MISC_FEATURE (243)..(243): Glu, Phe, Gly or Pro
  MISC_FEATURE (278)..(278): Lys, Glu, Asp or Gln
  MISC_FEATURE (280)..(280): Gln, Ala, His or Glu
  MISC_FEATURE (344)..(344): Asn, Glu, Pro or Asp
MGIRITGTGLFHPTDXITNEELVESLNAYVEXYNLENADKIAAGEIEELRASSAEFIEKASGIXRRYVAEKTGILDPKRLRPXLXERSNDELSXQAEWGVAAAKQAMENAGVTAEDIDVVILSCSNIQRAYPALAIEIQTALGIQGYAYDMNVACSAATFGIKQAADAIKSGARRVLMVNVEIXSGHTDFRSRDCHFIFGDVATASIIEETETKTGFEIEDIXLFTXFSNNIRNNFGYLNLSXVDADIDNNRFRQDGRKVFKEVCPLVAKMITKQLEXNXIEPTNVKRFWLHQANVNMNELILKLIVGKEHAKSELVPLILDEFANTSSAGVIIALHRTANEVXDGEYGVLCSFGAGYSVGSILVKKHVA

SEQ ID NO: 160 - protein, 9 aa, Artificial
  Sub-sequence of mutant 3-ketoacyl-CoA synthase
  MISC_FEATURE (2)..(2): Leu, Met or Thr
  MISC_FEATURE (8)..(8): Leu, Val, Ile or Met
LXVNVEIXS

SEQ ID NO: 161 - protein, 7 aa, Artificial
  Sub-sequence of 3-ketoacyl-CoA synthase
  MISC_FEATURE (3)..(3): Cys, Met, His or Asn
  MISC_FEATURE (5)..(5): Ala or Gly
DMXVXCS

SEQ ID NO: 162 - protein, 7 aa, Artificial
  Sub-sequence of mutant 3-ketoacyl-CoA synthase
  MISC_FEATURE (4)..(4): Gly or Ser
  MISC_FEATURE (5)..(5): Ser or Gly
ANTXXAG

SEQ ID NO: 163 - protein, 9 aa, Artificial
  Sub-sequence of mutant 3-ketoacyl-CoA synthase
  MISC_FEATURE (2)..(2): Leu, Met or Thr
LXVNVEIIS

SEQ ID NO: 164 - protein, 36 aa, Artificial; identical to SEQ ID NO: 44
  Sub-sequence of mutant 3-ketoacyl-CoA synthase
  MISC_FEATURE (3)..(3): Cys, Met, His, Asn or Thr
  MISC_FEATURE (5)..(5): Ala or Gly
  MISC_FEATURE (13)..(13): Leu or Ile
  MISC_FEATURE (17)..(17): Ala or Tyr
  MISC_FEATURE (22)..(22): Ala or Ser
  MISC_FEATURE (24)..(24): Ala or Gly
  MISC_FEATURE (29)..(29): Leu, Met or Thr
  MISC_FEATURE (35)..(35): Lau Val, Ile, Met or Thr

SEQ ID NO: 165 - protein, 89 aa, Artificial
  Sub-sequence of mutant 3-ketoacyl-CoA synthase
  MISC_FEATURE (3)..(3): Cys, Met, His, Asn or Thr
  MISC_FEATURE (5)..(5): Ala or Gly
  MISC_FEATURE (13)..(13): Leu or Ile
  MISC_FEATURE (17)..(17): Ala or Tyr
  MISC_FEATURE (22)..(22): Ala or Ser
  MISC_FEATURE (24)..(24): Ala or Gly
  MISC_FEATURE (29)..(29): Leu, Met or Thr
  MISC_FEATURE (35)..(35): Leu, Val, Ile or Met
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu, Asn or Val
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu, Asn, His, Gln or Ser
  MISC_FEATURE (78)..(78): Gln, Lys, Thr or Asp
  MISC_FEATURE (82)..(82): Asn or Ile
  MISC_FEATURE (83)..(83): Ile or Val
  MISC_FEATURE (87)..(87): Phe or Leu
  MISC_FEATURE (89)..(89): Phe or Tyr
DMXVXCSAATFGXKQAXDAIKXGXRRVLXVNVEIXSXHTDXRSRXCHFIFGDVATASIIEXTXXKTGFEIXDXXLFTXFSNXXRNNXGX

SEQ ID NO: 166 - protein, 49 aa, Artificial
  Sub-sequence of mutated 3-ketoacyl-CoA synthase
  MISC_FEATURE (7)..(7): Ala, Val, Ile or Leu
  MISC_FEATURE (8)..(8): Ser or Asn
  MISC_FEATURE (13)..(13): Ile or Thr
  MISC_FEATURE (15)..(15): Lys, Met or Gly
  MISC_FEATURE (17)..(17): Ile or Val
  MISC_FEATURE (20)..(20): Glu or Lys
  MISC_FEATURE (22)..(22): His or Asn
  MISC_FEATURE (23)..(23): Ala or Asp
  MISC_FEATURE (24)..(24): Gln, Lys, Glu or Met
  MISC_FEATURE (25)..(25): Pro or Ser
  MISC_FEATURE (26)..(26): Glu, Gly, Asp or Lys
  MISC_FEATURE (28)..(28): Val or Ala
  MISC_FEATURE (30)..(30): Met, Ile or Leu
  MISC_FEATURE (31)..(31): Ile or Val
  MISC_FEATURE (33)..(33): Asp, Asn or Gly
  MISC_FEATURE (39)..(39): Ser or Gly
  MISC_FEATURE (40)..(40): Ser or Gly
  MISC_FEATURE (45)..(45): Ile or Val
WLHQANXXMNELXLXLXVGXEXXXXXLXPXXLXEFANTXXAGVIXALHR

SEQ ID NO: 167 - protein, 189 aa, Artificial
  Sub-sequence of mutant 3-ketoacyl-CoA synthase
  MISC_FEATURE (3)..(3): Ile or Leu
  MISC_FEATURE (5)..(5): Ala or Gly
  MISC_FEATURE (13)..(13): Ile or Leu
  MISC_FEATURE (17)..(17): Ala or Tyr
  MISC_FEATURE (22)..(22): Ala or Ser
  MISC_FEATURE (24)..(24): Gly or Ala
  MISC_FEATURE (29)..(29): Leu, Met or Thr
  MISC_FEATURE (35)..(35): Leu, Val, Ile, Met or Cys
  MISC_FEATURE (37)..(37): Ala or Gly
  MISC_FEATURE (41)..(41): Phe or Tyr
  MISC_FEATURE (45)..(45): Asp or Gly
  MISC_FEATURE (61)..(61): Glu, Asn or Val
  MISC_FEATURE (63)..(63): Asp or Glu
  MISC_FEATURE (64)..(64): Ser or Thr
  MISC_FEATURE (71)..(71): Leu or Glu
  MISC_FEATURE (73)..(73): Ser or Ile
  MISC_FEATURE (74)..(74): Glu or Asn
  MISC_FEATURE (78)..(78): Gln, Lys, Thr or Asp
  MISC_FEATURE (82)..(82): Asn or Ile
  MISC_FEATURE (83)..(83): Ile or Val
  MISC_FEATURE (87)..(87): Phe or Leu
  MISC_FEATURE (89)..(89): Phe or Tyr
  MISC_FEATURE (92)..(92): Thr, Leu or Pro
  MISC_FEATURE (94)..(94): Glu, Phe, Gly or Pro
  MISC_FEATURE (95)..(95): Val or Missing
  MISC_FEATURE (96)..(96): Asn or Asp
  MISC_FEATURE (100)..(100): Asp or Glu
  MISC_FEATURE (101)..(101): Asp or Asn
  MISC_FEATURE (102)..(102): Lys or Asn
  MISC_FEATURE (105)..(105): Ala or Arg
  MISC_FEATURE (119)..(119): Ala or Val
  MISC_FEATURE (122)..(122): Ile or Met
  MISC_FEATURE (125)..(125): Ala, Lys or Glu
  MISC_FEATURE (129)..(129): Lys, Arg, Glu, Asp or Gly
  MISC_FEATURE (131)..(131): Asn, Gln, Ala, His or Glu
  MISC_FEATURE (133)..(133): Ala, Glu or Gly
  MISC_FEATURE (136)..(136): Gly, Asp or Asn
  MISC_FEATURE (147)..(147): Ala, Val, Ile or Leu
  MISC_FEATURE (148)..(148): Ser or Asn
  MISC_FEATURE (153)..(153): Ile or Thr
  MISC_FEATURE (155)..(155): Lys, Met or Gln
  MISC_FEATURE (157)..(157): Ile or Val
  MISC_FEATURE (160)..(160): Glu or Lys
  MISC_FEATURE (162)..(162): Asn or His
  MISC_FEATURE (163)..(163): Ala or Asp
  MISC_FEATURE (164)..(164): Lys, Gln, Glu, Met
  MISC_FEATURE (165)..(165): Pro or Ser
  MISC_FEATURE (166)..(166): Gly, Asp, Glu or Lys
  MISC_FEATURE (168)..(168): Val or Ala
  MISC_FEATURE (170)..(170): Met, Ile or Leu
  MISC_FEATURE (171)..(171): Ile or Val
  MISC_FEATURE (173)..(173): Asn, Asp or Gly
  MISC_FEATURE (179)..(179): Ser or Gly
  MISC_FEATURE (180)..(180): Ser or Gly
  MISC_FEATURE (185)..(185): Ile or Val
DMXVXCSAATFGXKQAXDAIKXGXRRVLXVNVEIXSXHTDXRSRXCHFIFGDVATASIIEXTXXKTGFEIXDXXLFTQFSNXXRNNXGXLNXSEXXADIXXXRFXQDGRKVFKEVCPLXAKXITXQLEXNXIXPTXVKRFWLHQANXXMNELXLXLXVGXEXXXXXLXPXXLXEFANTXXAGVIXALHR

SEQ ID NO: 168 - protein, 149 aa, Artificial
  Sub-sequence of mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile, Phe, Thr, Val or Ser
  MISC_FEATURE (18)..(18): Thr or Ala
  MISC_FEATURE (22)..(22): Leu or Met
  MISC_FEATURE (30)..(30): Val or Ala
  MISC_FEATURE (32)..(32): Leu, Gln, Arg or Gly
  MISC_FEATURE (33)..(33): Phe or Tyr
  MISC_FEATURE (35)..(35): His or Leu
  MISC_FEATURE (36)..(36): Glu or Asp
  MISC_FEATURE (38)..(38): Ala or Val
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp, Gly, Cys, Asp, Glu, Phe, His, Ile, Lys, Met, Asn, Pro, Gln, Arg, Ser, Thr, Val, Trp, Tyr
  MISC_FEATURE (54)..(54): Val or Ala
  MISC_FEATURE (63)..(63): Val or Ile
  MISC_FEATURE (64)..(64): Gln, Lys, Glu or Gly
  MISC_FEATURE (69)..(69): Ala or Val
  MISC_FEATURE (72)..(72): Ser or Thr
  MISC_FEATURE (83)..(83): Asn, Leu, His or Phe
  MISC_FEATURE (85)..(85): Pro, His, Arg, Gln or Asp
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile, Leu, Thr, Glu or Ala
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (116)..(116): Asp or Glu
  MISC_FEATURE (119)..(119): Ile or Val
  MISC_FEATURE (127)..(127): Ile, Leu or Thr
  MISC_FEATURE (130)..(130): Ala, Gly or Pro
  MISC_FEATURE (134)..(134): Leu or Val
  MISC_FEATURE (145)..(145): Lys or Gln
MGIRITGTGLXHPXXXIXNEEXVESLNAYXEXXNXXNXXKIAXGEXEXXRXSSXEFIEKASGXXRRYVXEKXGILDPKRLRPXLXERXXDEXSXQAEWGXXAAKQAMXNAXVTAEXIDXVILSCSNXQRXYPAXAIEIQTALGIXGYAY

SEQ ID NO: 169 - protein, 338 aa, Artificial
  Sub-sequence of mutant 3-ketoacyl-CoA synthase
  MISC_FEATURE (11)..(11): Phe or Tyr
  MISC_FEATURE (14)..(14): Glu or Thr
  MISC_FEATURE (15)..(15): His, Asn or Asp
  MISC_FEATURE (16)..(16): Val, Ile, Phe, Thr or Ser
  MISC_FEATURE (18)..(18): Thr or Ala
  MISC_FEATURE (22)..(22): Leu or Met
  MISC_FEATURE (30)..(30): Val or Ala
  MISC_FEATURE (32)..(32): Leu, Gln, Arg and Gly
  MISC_FEATURE (33)..(33): Phe or Tyr
  MISC_FEATURE (35)..(35): His or Leu
  MISC_FEATURE (36)..(36): Glu or Asp
  MISC_FEATURE (38)..(38): Ala or Val
  MISC_FEATURE (39)..(39): Asp or Val
  MISC_FEATURE (43)..(43): Ala or Ser
  MISC_FEATURE (46)..(46): Ile or Leu
  MISC_FEATURE (48)..(48): Glu or Ala
  MISC_FEATURE (49)..(49): Arg or Leu
  MISC_FEATURE (51)..(51): Asp, Gly, Ala, Cys, Glu, Phe, His, Ile, Lys, Leu, Met, Asn, Pro, Gln, Arg, Ser, Thr, Val, Trp or Try
  MISC_FEATURE (54)..(54): Val or Ala
  MISC_FEATURE (63)..(63): Val or Ile
  MISC_FEATURE (64)..(64): Gln, Lys, Glu or Gly
  MISC_FEATURE (69)..(69): Ala or Val
  MISC_FEATURE (72)..(72): Ser or Thr
  MISC_FEATURE (83)..(83): Asn, Leu, His or Phe
  MISC_FEATURE (85)..(85): Pro, His, Arg, Gln or Asp
  MISC_FEATURE (88)..(88): Ala or Ser
  MISC_FEATURE (89)..(89): Asp or Asn
  MISC_FEATURE (92)..(92): Ile or Leu
  MISC_FEATURE (94)..(94): Ile, Leu, Thr, Glu or Ala
  MISC_FEATURE (100)..(100): Val or Ile
  MISC_FEATURE (101)..(101): Ala or Ile
  MISC_FEATURE (108)..(108): Glu or Asp
  MISC_FEATURE (111)..(111): Gly or Cys
  MISC_FEATURE (116)..(116): Asp or Glu
  MISC_FEATURE (119)..(119): Ile or Val
  MISC_FEATURE (127)..(127): ILe, Leu or Thr
  MISC_FEATURE (130)..(130): Ala, Gly or Pro
  MISC_FEATURE (134)..(134): Leu or Val
  MISC_FEATURE (145)..(145): Lys or Gln
  MISC_FEATURE (152)..(152): Cys, Met, His, Asn or THr
  MISC_FEATURE (154)..(154): Ala or Gly
  MISC_FEATURE (162)..(162): Leu or Ile
  MISC_FEATURE (166)..(166): Tyr or Ala
  MISC_FEATURE (171)..(171): Ala or Ser
  MISC_FEATURE (173)..(173): Gly or Ala
  MISC_FEATURE (178)..(178): Leu, Met or Thr
  MISC_FEATURE (184)..(184): Leu, Val, Ile, Met or Cys
  MISC_FEATURE (186)..(186): Ala or Gly
  MISC_FEATURE (190)..(190): Phe or Tyr
  MISC_FEATURE (194)..(194): Asp or Gly
  MISC_FEATURE (210)..(210): Glu, Asn or Val
  MISC_FEATURE (212)..(212): Asp or Glu
  MISC_FEATURE (213)..(213): Ser or Thr
  MISC_FEATURE (220)..(220): Leu or Glu
  MISC_FEATURE (222)..(222): Ser or Ile
  MISC_FEATURE (223)..(223): Glu, Asn, His, Gln or Ser
  MISC_FEATURE (227)..(227): Gln, Lys, Thr or Asp
  MISC_FEATURE (231)..(231): Asn or Ile
  MISC_FEATURE (232)..(232): Ile or Val
  MISC_FEATURE (236)..(236): Phe, Leu
  MISC_FEATURE (238)..(289): Phe or Tyr
  MISC_FEATURE (241)..(241): Thr, Leu or Pro
  MISC_FEATURE (243)..(243): Glu, Phe, Gly or Pro
  MISC_FEATURE (244)..(244): Val or missing
  MISC_FEATURE (245)..(245): Asn or Asp
  MISC_FEATURE (249)..(249): Asn or Asp
  MISC_FEATURE (250)..(250): Asp or Glu
  MISC_FEATURE (251)..(251): Lys or Asn
  MISC_FEATURE (254)..(254): Arg or Ala
  MISC_FEATURE (268)..(268): Val or Ala
  MISC_FEATURE (271)..(271): Met or Ile
  MISC_FEATURE (274)..(274): Ala, Lys or Glu
  MISC_FEATURE (278)..(278): Lys, Arg, Glu, Asp or Gln
  MISC_FEATURE (280)..(280): Gln, Asn, Ala, His or Glu
  MISC_FEATURE (282)..(282): Glu, Ala or Gly
  MISC_FEATURE (285)..(285): Gly, Asp or Asn
  MISC_FEATURE (296)..(296): Ala, Val, Ile or Leu
  MISC_FEATURE (297)..(297): Ser or Asn
  MISC_FEATURE (302)..(302): Ile or Thr
  MISC_FEATURE (304)..(304): Lys, Met or Gln
  MISC_FEATURE (306)..(306): Val or Ile
  MISC_FEATURE (309)..(309): Glu or Lys
  MISC_FEATURE (311)..(311): Asn or His
  MISC_FEATURE (312)..(312): Ala or Asp
  MISC_FEATURE (313)..(313): Lys, Gln, Glu or Met
  MISC_FEATURE (314)..(314): Pro or Ser
  MISC_FEATURE (315)..(315): Gly, Asp, Glu or Lys
  MISC_FEATURE (317)..(317): Val or Ala
  MISC_FEATURE (319)..(319): Met, Ile or Leu
  MISC_FEATURE (320)..(320): Ile or Val
  MISC_FEATURE (322)..(322): Asn, Asp or Gly
  MISC_FEATURE (328)..(328): Ser or Gly
  MISC_FEATURE (329)..(329): Ser or Gly
  MISC_FEATURE (334)..(334): Ile or Val
MGIRITGTGLXHPXXXIXNEEXVESLNAYXEXXNXXNXXKIAXGEXEXXRXSSXEFIEKASGXXRRYVXEKXGILDPKRLRPXLXERXXDEXSXQAEWGXXAAKQAMXNAXVTAEXIDXVILSCSNXQRXYPAXAIEIQTALGIXGYAYDMXVXCSAATFGXKQAXDAIKXGXRRVLXVNVEIXSXHTDXRSRXCHFIFGDVATASIIEXTXXKTGFEIXDXXLFTXFSNXXRNNXGXLNXSXXXADIXXXRFXQDGRKVFKEVCPLXAKXITXQLEXNXIXPTXVKRFWLHQANXXMNELXLXLXVGXEXXXXXLXPXXLXEFANTXXAGVIXALHR

SEQ ID NO: 170 - protein, 10 aa, Artificial
  Sub-sequence of mutant 3-ketoacyl-CoA synthase
  MISC_FEATURE (1)..(1): Ala, Cys, Asp, Glu, Phe, His, Ile, Lys, Leu, Met, Asn, Pro, Gln, Arg, Ser, Thr, Val, Trp or Tyr
  MISC_FEATURE (4)..(4): Val or Ala
  MISC_FEATURE (5)..(5): Glu or Asp
XSSXEFIEKA

SEQ ID NO: 171 - protein, 10 aa, Artificial
  Sub-sequence of native 3-ketoacyl-CoA synthase of Acinetobacter schindleri CIP 107287
  MISC_FEATURE (5)..(5): Glu or Asp
GSSAXFIEKA

SEQ ID NO: 172 - protein, 370 aa, Artificial
  Mutant 3-ketoacyl-CoA synthase
MGIRITGTGLFHPTDFITNEELVESLNAYVEQYNLENADKIAAGEIEELRASSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 173 - protein, 370 aa, Artificial
  Mutant 3-ketoacyl-CoA synthase
MGIRITGTGLFHPTDFITNEELVESLNAYVEQYNLENADKIAAGEIEELRCSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANVNMNELILKLIVGKEHAKSELVPLILDEFANTGSAGVIIALHRTANEVNDGEYGVLCSFGAGYSVGSILVKKHVA

SEQ ID NO: 174 - protein, 370 aa, Artificial
  Mutant 3-keto-acyl-CoA synthase
MGIRITGTGLFHPTDFITNEELVESLNAYVEQYNLENADKIAAGEIEELRDSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 175 - protein, 370 aa, ArtificialMGIRITGTGL Artificial
MGIRITGTGLFHPTDFITNEELVESLNAYVEQYNLENADKIAAGEIEELRHSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 176 - protein, 370 aa, Artificial
  Mutant 3-ketoacyl-CoA synthase
MGIRITGTGLFHPTDFITNEELVESLNAYVEQYNLENADKIAAGEIEELRISSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 177 - protein, 370 aa, Artificial
  Mutant 3-ketoacyl-CoA synthase
MGIRITGTGLFHPTDFITNEELVESLNAYVEQYNLENADKIAAGEIEELRKSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 178 - protein, 370 aa, Artificial
  Mutant 3-ketoacyl-CoA synthase
MGIRITGTGLFHPTDFITNEELVESLNAYVEQYNLENADKIAAGEIEELRLSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 179 - protein, 370 aa, Artificial
  Mutant 3-ketoacyl-CoA synthase
MGIRITGTGLFHPTDFITNEELVESLNAYVEQYNLENADKIAAGEIEELRMSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 180 - protein, 370 aa, Artificial
  Mutant 3-ketoacylCoA synthase
MGIRITGTGLFHPTDFITNEELVESLNAYVEQYNLENADKIAAGEIEELRNSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 181 - protein, 370 aa, Artificial
  Mutant 3-ketoacyl-CoA synthase
MGIRITGTGLFHPTDFITNEELVESLNAYVEQYNLENADKIAAGEIEELRPSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 182 - protein, 370 aa, Artificial
  Mutant 3-ketoacyl-CoA synthase
MGIRITGTGLFHPTDFITNEELVESLNAYVEQYNLENADKIAAGEIEELRQSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 183 - protein, 370 aa, Artificial
  Mutant 3-ketoacyl-CoA synthase
MGIRITGTGLFHPTDFITNEELVESLNAYVEQYNLENADKIAAGEIEELRRSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 184 - protein, 370 aa, Artificial
  Mutant 3-ketoacyl-CoA synthase
MGIRITGTGLFHPTDFITNEELVESLNAYVEQYNLENADKIAAGEIEELRSSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 185 - protein, 370 aa, Artificial
  Mutant 3-ketoacyl-CoA synthase
MGIRITGTGLFHPTDFITNEELVESLNAYVEQYNLENADKIAAGEIEELRTSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 186 - protein, 370 aa, Artificial
  Mutant 3-ketoacyl-CoA synthase
MGIRITGTGLFHPTDFITNEELVESLNAYVEQYNLENADKIAAGEIEELRVSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 187 - protein, 370 aa, Artificial
  Mutant 3-ketoacyl-CoA synthase
MGIRITGTGLFHPTDFITNEELVESLNAYVEQYNLENADKIAAGEIEELRWSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 188 - protein, 370 aa, Artificial
  Mutant 3-ketoacyl-CoA synthase
MGIRITGTGLFHPTDFITNEELVESLNAYVEQYNLENADKIAAGEIEELRYSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

SEQ ID NO: 189 - protein, 370 aa, Artificial
  Mutant 3-ketoacyl-CoA synthase
MGIRITGTGLFHPTDFITNEELVESLNAYAEQYNLENADKIAAGEIEELRCSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 190 - protein, 370 aa, Artificial
  Mutant 3-ketoacyl-CoA synthase
MGIRITGTGLFHPTDFITNEELVESLNAYAEQYNLENADKIAAGEIEELRDSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 191 - protein, 370 aa, Artificial
  Mutant 3-ketoacyl-CoA synthase
MGIRITGTGLFHPTDFITNEELVESLNAYAEQYNLENADKIAAGEIEELRESSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 192 - protein, 370 aa, Artificial
  Mutant 3-ketoacyl-CoA synthase
MGIRITGTGLFHPTDFITNEELVESLNAYAEQYNLENADKIAAGEIEELRFSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 193 - protein, 370 aa, Artificial
  Mutant 3-ketoacyl-CoA synthase
MGIRITGTGLFHPTDFITNEELVESLNAYAEQYNLENADKIAAGEIEELRHSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 194 - protein, 370 aa, Artificial
  Mutant 3-ketoacyl-CoA synthase
MGIRITGTGLFHPTDFITNEELVESLNAYAEQYNLENADKIAAGEIEELRISSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 195 - protein, 370 aa, Artificial
  Mutant 3-ketoacyl-CoA synthase
MGIRITGTGLFHPTDFITNEELVESLNAYAEQYNLENADKIAAGEIEELRKSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 196 - protein, 370 aa, Artificial
  Mutant 3-ketoacyl-CoA synthase
MGIRITGTGLFHPTDFITNEELVESLNAYAEQYNLENADKIAAGEIEELRMSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 197 - protein, 370 aa, Artificial
  Mutant 3-ketoacyl-CoA synthase
MGIRITGTGLFHPTDFITNEELVESLNAYAEQYNLENADKIAAGEIEELRNSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 198 - protein, 370 aa, Artificial
  Mutant 3-ketoacyl-CoA synthase
MGIRITGTGLFHPTDFITNEELVESLNAYAEQYNLENADKIAAGEIEELRPSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 199 - protein, 370 aa, Artificial
  Mutant 3-ketoacyl-CoA synthase
MGIRITGTGLFHPTDFITNEELVESLNAYAEQYNLENADKIAAGEIEELRRSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 200 - protein, 370 aa, Artificial
  Mutant 3-ketoacyl-CoA synthase
MGIRITGTGLFHPTDFITNEELVESLNAYAEQYNLENADKIAAGEIEELRSSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 201 - protein, 370 aa, Artificial
  Mutant 3-ketoacyl-CoA synthase
MGIRITGTGLFHPTDFITNEELVESLNAYAEQYNLENADKIAAGEIEELRTSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 202 - protein, 370 aa, Artificial
  Mutant 3-ketoacyl-CoA synthase
MGIRITGTGLFHPTDFITNEELVESLNAYAEQYNLENADKIAAGEIEELRWSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 203 - protein, 370 aa, Artificial
  Mutant 3-ketoacyl-CoA synthase
MGIRITGTGLFHPTDFITNEELVESLNAYAEQYNLENADKIAAGEIEELRYSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNNIRNNFGYLNLSEVDADIDNNRFRQDGRKVFKEVCPLAAKMITKQLEKNQIEPTNVKRFWLHQANANMNELILKLIVGKEHAKSELAPLILDEFANTGSAGVIIALHRTANEVNDGEYGVLCSFGAGYSVGSILVKKRVA

SEQ ID NO: 204 - protein, 370 aa, Artificial
  Mutant 3-ketoacyl-CoA synthase
MGIRITGTGLFHPTDFITNEELVESLNAYVEQYNLENADKIAAGEIEELRGSSAEFIEKASGIKRRYVAEKTGILDPKRLRPLLHERSNDELSIQAEWGVAAAKQAMENAGVTAEDIDVVILSCSNIQRAYPALAIEIQTALGIQGYAYDMNVACSAATFGIKQAADAIKSGARRVLMVNVEIISGHTDFRSRDCHFIFGDVATASIIEETETKTGFEIEDIELFTQFSNIIRNNFGYLNLSEVDADIDNNRFRQDGRKVFKEVCPLAAKMITKQLEKNQIEPTNVKRFWLHQANANMNELILKLIVGKEHAKSELVPLILDEFANTGSAGVIIALHRTANEVNDGEYGVLCSFGAGYSVGSILVKKHVA

The invention claimed is:
1. A ketoacyl-CoA synthase having SEQ ID NO: 119 or being at least 80% identical to SEQ ID NO: 119, wherein the amino acid residue of the ketoacyl-CoA synthase that aligns with amino acid residue 184 of SEQ ID NO: 119 is isoleucine, leucine, methionine or valine.
2. The ketoacyl-CoA synthase of claim 1, comprising at least one of the following features i) to xliii):
   i) an amino acid residue of the ketoacyl-CoA synthase that aligns with amino acid residue 18 of SEQ ID NO: 119 is alanine;
   ii) an amino acid residue of the ketoacyl-CoA synthase that aligns with amino acid residue 22 of SEQ ID NO: 119 is methionine;
   iii) an amino acid residue of the ketoacyl-CoA synthase that aligns with amino acid residue 30 of SEQ ID NO: 119 is alanine;
   iv) an amino acid residue of the ketoacyl-CoA synthase that aligns with amino acid residue 38 of SEQ ID NO: 119 is valine;
   v) an amino acid residue of the ketoacyl-CoA synthase that aligns with amino acid residue 39 of SEQ ID NO: 119 is valine;
   vi) an amino acid residue of the ketoacyl-CoA synthase that aligns with amino acid residue 51 of SEQ ID NO: 119 is alanine, cysteine, aspartic acid, histidine, isoleucine, lysine, leucine, methionine, asparagine, proline, glutamine, arginine, serine, threonine, valine, tryptophan or tyrosine;
   vii) an amino acid residue of the ketoacyl-CoA synthase that aligns with amino acid residue 54 of SEQ ID NO: 119 is valine;
   viii) an amino acid residue of the ketoacyl-CoA synthase that aligns with amino acid residue 69 of SEQ ID NO: 119 is valine;
   ix) an amino acid residue of the ketoacyl-CoA synthase that aligns with amino acid residue 83 of SEQ ID NO: 119 is asparagine;

x) an amino acid residue of the ketoacyl-CoA synthase that aligns with amino acid residue 94 of SEQ ID NO: 119 is threonine, leucine, glutamic acid, or alanine;

xi) an amino acid residue of the ketoacyl-CoA synthase that aligns with amino acid residue 111 of SEQ ID NO: 119 is cysteine;

xii) an amino acid residue of the ketoacyl-CoA synthase that aligns with amino acid residue 116 of SEQ ID NO: 119 is glycine;

xiii) an amino acid residue of the ketoacyl-CoA synthase that aligns with amino acid residue 127 of SEQ ID NO: 119 is a threonine;

xiv) an amino acid residue of the ketoacyl-CoA synthase that aligns with amino acid residue 130 of SEQ ID NO: 119 is glycine;

xv) an amino acid residue of the ketoacyl-CoA synthase that aligns with amino acid residue 152 of SEQ ID NO: 119 is cysteine, leucine, methionine or threonine;

xvi) an amino acid residue of the ketoacyl-CoA synthase that aligns with amino acid residue 154 of SEQ ID NO: 119 is glycine;

xvii) an amino acid residue of the ketoacyl-CoA synthase that aligns with amino acid residue 178 of SEQ ID NO: 119 is leucine or threonine;

xviii) an amino acid residue of the ketoacyl-CoA synthase that aligns with amino acid residue 190 of SEQ ID NO: 119 is phenylalanine or tyrosine;

xix) an amino acid residue of the ketoacyl-CoA synthase that aligns with amino acid residue 210 of SEQ ID NO: 119 is valine;

xx) an amino acid residue of the ketoacyl-CoA synthase that aligns with amino acid residue 223 of SEQ ID NO: 119 is histidine;

xxi) an amino acid residue of the ketoacyl-CoA synthase that aligns with amino acid residue 231 of SEQ ID NO: 119 is isoleucine;

xxii) an amino acid residue of the ketoacyl-CoA synthase that aligns with amino acid residue 232 of SEQ ID NO: 119 is valine;

xxiii) an amino acid residue of the ketoacyl-CoA synthase that aligns with amino acid residue 236 of SEQ ID NO: 119 is leucine or methionine;

xxiv) an amino acid residue of the ketoacyl-CoA synthase that aligns with amino acid residue 241 of SEQ ID NO: 119 is proline;

xxv) an amino acid residue of the ketoacyl-CoA synthase that aligns with amino acid residue 268 of SEQ ID NO: 119 is alanine;

xxvi) an amino acid residue of the ketoacyl-CoA synthase that aligns with amino acid residue 271 of SEQ ID NO: 119 is isoleucine;

xxvii) an amino acid residue of the ketoacyl-CoA synthase that aligns with amino acid residue 274 of SEQ ID NO: 119 is glutamic acid;

xxviii) an amino acid residue of the ketoacyl-CoA synthase that aligns with amino acid residue 278 of SEQ ID NO: 119 is arginine, glutamic acid, aspartic acid, glutamine;

xxix) an amino acid residue of the ketoacyl-CoA synthase that aligns with amino acid residue 280 of SEQ ID NO: 119 is isoleucine;

xxx) an amino acid residue of the ketoacyl-CoA synthase that aligns with amino acid residue 282 of SEQ ID NO: 119 is glycine;

xxxi) an amino acid residue of the ketoacyl-CoA synthase that aligns with amino acid residue 296 of SEQ ID NO: 119 is alanine;

xxxii) an amino acid residue of the ketoacyl-CoA synthase that aligns with amino acid residue 302 of SEQ ID NO: 119 is threonine;

xxxiii) an amino acid residue of the ketoacyl-CoA synthase that aligns with amino acid residue 312 of SEQ ID NO: 119 is aspartic acid;

xxxiv) an amino acid residue of the ketoacyl-CoA synthase that aligns with amino acid residue 313 of SEQ ID NO: 119 is glutamic acid or methionine;

xxxv) an amino acid residue of the ketoacyl-CoA synthase that aligns with amino acid residue 315 of SEQ ID NO: 119 is lysine;

xxxvi) an amino acid residue of the ketoacyl-CoA synthase that aligns with amino acid residue 317 of SEQ ID NO: 119 is alanine;

xxxvii) an amino acid residue of the ketoacyl-CoA synthase that aligns with amino acid residue 322 of SEQ ID NO: 119 is glycine;

xxxviii) an amino acid residue of the ketoacyl-CoA synthase that aligns with amino acid residue 328 of SEQ ID NO: 119 is glycine;

xxxix) an amino acid residue of the ketoacyl-CoA synthase that aligns with amino acid residue 329 of SEQ ID NO: 119 is glycine;

xl) an amino acid residue of the ketoacyl-CoA synthase that aligns with amino acid residue 344 of SEQ ID NO: 119 is glutamic acid, aspartic acid or asparagine;

xli) an amino acid residue of the ketoacyl-CoA synthase that aligns with amino acid residue 356 of SEQ ID NO: 119 is glycine or serine;

xlii) an amino acid residue of the ketoacyl-CoA synthase that aligns with amino acid residue 368 of SEQ ID NO: 119 is arginine; and xliii) an amino acid residue of the ketoacyl-CoA synthase that aligns with amino acid residue 370 of SEQ ID NO: 119 is threonine.

3. The ketoacyl-CoA synthase of claim 1 wherein the amino acid residue of the ketoacyl-CoA synthase that aligns with amino acid residue 184 of SEQ ID NO: 119 is isoleucine.

4. The ketoacyl-CoA synthase of claim 1 further comprising at least one of the following features:
the amino acid residue of the ketoacyl-CoA synthase that aligns with amino acid residue 268 of SEQ ID NO: 119 is alanine;
the amino acid residue of the ketoacyl-CoA synthase that aligns with amino acid residue 296 of SEQ ID NO: 119 is alanine; and
the amino acid residue of the ketoacyl-CoA synthase that aligns with amino acid residue 328 of SEQ ID NO: 119 is glycine.

5. The ketoacyl-CoA synthase of claim 1 wherein the amino acid residue of the ketoacyl-CoA synthase that aligns with amino acid residue 317 of SEQ ID NO: 119 is alanine.

6. The ketoacyl-CoA synthase of claim 2 wherein the amino acid residue of the ketoacyl-CoA synthase that aligns with amino acid residue 30 of SEQ ID NO: 119 is alanine.

7. The ketoacyl-CoA synthase of claim 2 wherein the amino acid residue of the ketoacyl-CoA synthase that aligns with amino acid residue 368 of SEQ ID NO: 119 is arginine.

8. The ketoacyl-CoA synthase of claim 1 wherein the amino acid residue of the ketoacyl-CoA synthase that aligns with amino acid residue 51 of SEQ ID NO: 119 is alanine, cysteine, aspartic acid, histidine, isoleucine, lysine, leucine, methionine, asparagine, proline, glutamine, arginine, serine, threonine, valine, tryptophan or tyrosine.

9. The ketoacyl-CoA synthase of claim 1 wherein the amino acid residue of the ketoacyl-CoA synthase that aligns with amino acid residue 51 of SEQ ID NO: 119 is alanine.

10. The 3-ketoacyl-CoA synthase of claim 1 wherein the amino acid sequence is selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 92, SEQ ID NO: 93, any of SEQ ID NOs: 121-157 and any one of SEQ ID NOs: 172-204.

11. A 3-ketoacyl-CoA synthase gene encoding for a 3-ketoacyl-CoA synthase of claim 1.

12. A genetically modified cell comprising a 3-ketoacyl-CoA synthase gene of claim 11.

13. A ketoacyl-CoA synthase having SEQ ID NO: 110 or being at least 80% identical to SEQ ID NO: 110, comprising at least one of features i)-ix):
   i) an amino acid residue of the ketoacyl-CoA synthase that aligns with amino acid residue 30 of SEQ ID NO: 110 is alanine;
   ii) an amino acid residue of the ketoacyl-CoA synthase that aligns with amino acid residue 39 of SEQ ID NO: 110 is valine;
   iii) an amino acid residue of the ketoacyl-CoA synthase that aligns with amino acid residue 111 of SEQ ID NO: 110 is cysteine;
   iv) an amino acid residue of the ketoacyl-CoA synthase that aligns with amino acid residue 152 of SEQ ID NO: 110 is cysteine, leucine, methionine or threonine;
   v) an amino acid residue of the ketoacyl-CoA synthase that aligns with amino acid residue 184 of SEQ ID NO: 110 is isoleucine, leucine, methionine or valine;
   vi) an amino acid residue of the ketoacyl-CoA synthase that aligns with amino acid residue 268 of SEQ ID NO: 110 is alanine;
   vii) an amino acid residue of the ketoacyl-CoA synthase that aligns with amino acid residue 271 of SEQ ID NO: 110 is isoleucine;
   viii) an amino acid residue of the ketoacyl-CoA synthase that aligns with amino acid residue 278 of SEQ ID NO: 110 is arginine, glutamic acid, aspartic acid, or glutamine;
   ix) an amino acid residue of the ketoacyl-CoA synthase that aligns with amino acid residue 328 of SEQ ID NO: 110 is glycine.

14. The ketoacyl-CoA synthase of claim 13 wherein the amino acid residue of the ketoacyl-CoA synthase that aligns with amino acid residue 184 of SEQ ID NO: 110 is isoleucine, leucine, methionine or valine.

15. The ketoacyl-CoA synthase of claim 13 wherein the amino acid residue of the ketoacyl-CoA synthase that aligns with amino acid residue 184 of SEQ ID NO: 110 is isoleucine.

16. The ketoacyl-CoA synthase of claim 13 wherein:
   the amino acid residue of the ketoacyl-CoA synthase that aligns with amino acid residue 268 of SEQ ID NO: 110 is alanine;
   the amino acid residue of the ketoacyl-CoA synthase that aligns with amino acid residue 296 of SEQ ID NO: 110 is alanine; and
   the amino acid residue of the ketoacyl-CoA synthase that aligns with amino acid residue 328 of SEQ ID NO: 110 is glycine.

17. The ketoacyl-CoA synthase of claim 13, further comprising an amino acid residue of the ketoacyl-CoA synthase that aligns with amino acid residue 317 of SEQ ID NO: 110 is alanine.

18. The ketoacyl-CoA synthase of claim 14 wherein the amino acid residue of the ketoacyl-CoA synthase that aligns with amino acid residue 30 of SEQ ID NO: 110 is alanine.

19. The ketoacyl-CoA synthase of claim 14 wherein the amino acid residue of the ketoacyl-CoA synthase that aligns with amino acid residue 368 of SEQ ID NO: 110 is arginine.

20. The ketoacyl-CoA synthase of claim 13, further comprising at least one of features a)-d):
   a) an amino acid residue of the ketoacyl-CoA synthase that aligns with amino acid residue 69 of SEQ ID NO: 110 is valine;
   b) an amino acid residue of the ketoacyl-CoA synthase that aligns with amino acid residue 178 of SEQ ID NO: 110 is leucine or threonine;
   c) an amino acid residue of the ketoacyl-CoA synthase that aligns with amino acid residue 296 of SEQ ID NO: 110 is alanine;
   d) an amino acid residue of the ketoacyl-CoA synthase that aligns with amino acid residue 317 of SEQ ID NO: 110 is alanine.

* * * * *